(12) United States Patent
Ekblad et al.

(10) Patent No.: US 9,873,729 B2
(45) Date of Patent: Jan. 23, 2018

(54) POLYPEPTIDES

(71) Applicant: AFFIBODY AB, Solna (SE)

(72) Inventors: Caroline Ekblad, Saltsjö-Boo (SE); Elin Gunneriusson, Saltsjöbaden (SE); Malin Lindborg, Broma (SE); Lars Abrahmsen, Stockholm (SE); John Löblom, Huddinge (SE); Torbjörn Gräslund, Hägersten (SE); Johan Seijsing, Stockholm (SE)

(73) Assignee: AFFIBODY AB, Solna (SE)

( * ) Notice: Subject to any disclaimer, the term of this patent is extended or adjusted under 35 U.S.C. 154(b) by 0 days.

(21) Appl. No.: 14/776,319

(22) PCT Filed: Mar. 17, 2014

(86) PCT No.: PCT/EP2014/055299
§ 371 (c)(1),
(2) Date: Sep. 14, 2015

(87) PCT Pub. No.: WO2014/140366
PCT Pub. Date: Sep. 18, 2014

(65) Prior Publication Data
US 2016/0031967 A1 Feb. 4, 2016

Related U.S. Application Data

(60) Provisional application No. 61/787,305, filed on Mar. 15, 2013.

(30) Foreign Application Priority Data

Mar. 15, 2013 (EP) ..................................... 13159500

(51) Int. Cl.
*C07K 14/745* (2006.01)
*C07K 14/735* (2006.01)
*C07K 14/74* (2006.01)
*C07K 14/31* (2006.01)
*C07K 14/435* (2006.01)
*A61K 38/00* (2006.01)

(52) U.S. Cl.
CPC ............ *C07K 14/745* (2013.01); *C07K 14/31* (2013.01); *C07K 14/435* (2013.01); *C07K 14/70535* (2013.01); *C07K 14/70539* (2013.01); *A61K 38/00* (2013.01); *C07K 2319/74* (2013.01)

(58) Field of Classification Search
CPC ...... A61K 38/00; C07K 14/31; C07K 14/435; C07K 14/70535; C07K 14/70539; C07K 14/745; C07K 2319/74
See application file for complete search history.

(56) References Cited

U.S. PATENT DOCUMENTS 6,602,977 B1 * 8/2003 Ljungqvist ............. C07K 14/31
530/300

FOREIGN PATENT DOCUMENTS

WO 2010054699 A1 5/2010
WO 2011056124 A1 5/2011

OTHER PUBLICATIONS

Dilip K. Challa, Autoantibody depletion ameliorates disease in murine experimental autoimmune encephalomyelitis, mAbs 5:5, 655-659; Sep./Oct. 2013.*
Merck Manuals, Autoimmune disorders, by Peter J. Delves, accessed on Dec. 6, 2016.*
Mayo Clinic, Dilated Cardiomyopathy, Diseases and conditions, accessed on Dec. 6, 2016.*
Andersen et al., "Extending Half-Life by Indirect Targeting of the Neonatal Fc Receptor (FcRn) Using a Minimal Albumin Binding Domain" The Journal of Biological Chemistry; vol. 286; No. 7; Feb. 18, 2011; pp. 5234-5241.
International Search Report of International Searching Authority for International Patent Application No. PCT/EP2014/055299; International Filing Date: Mar. 17, 2014; dated May 8, 2014; 5 Pages.
Jonsson et al., "Engineering of a Femtomolar Affinity Binding Protein to Human Serum Albumin" Protein Engineering, Design & Selection; vol. 21; No. 8; (2008); pp. 515-527.

* cited by examiner

*Primary Examiner* — Hasan S Ahmed
*Assistant Examiner* — Erinne R Dabkowski
(74) *Attorney, Agent, or Firm* — Cantor Colburn LLP

(57) ABSTRACT

The present disclosure relates to a class of engineered polypeptides having a binding affinity for the neonatal Fc receptor (in the following referred to as FcRn), and provides an FcRn binding polypeptide comprising the sequence $EX_2X_3X_4AX_6X_7$ EIRWLPNL $X_{16}X_{17}X_{18}QRX_{21}$ $AFIX_{25}X_{26}LX_{28}X_{29}$ (SEQ ID NO: 1075). The present disclosure also relates to the use of such an FcRn binding polypeptide as an agent for modifying pharmacokinetic and pharmacodynamic properties and as a therapeutic agent.

46 Claims, 54 Drawing Sheets

Figure 1A

| Designation | Sequence | SEQ ID NO: |
|---|---|---|
| BM07918 | EQDAAAHEIRWLPNLTFDQRVAFIHKLAD | SEQ ID NO:1 |
| BM10193 | EWMRAAHEIRWLPNLTFDQRVAFIHKLED | SEQ ID NO:2 |
| BM10109 | EANTAAHEIRWLPNLTFDQRVAFIRKLWD | SEQ ID NO:3 |
| BM07960 | EFESAAHEIRWLPNLTYDQRVAFIHKLSD | SEQ ID NO:4 |
| BM10140 | ERSAAAHEIRWLPNLTFDQRVAFILKLTD | SEQ ID NO:5 |
| BM07930 | ESDSAVHEIRWLPNLTFDQRVAFIHKLLD | SEQ ID NO:6 |
| BM10183 | EADNAGHEIRWLPNLTWAQRWAFIHKLLD | SEQ ID NO:7 |
| BM10111 | EDDTAAHEIRWLPNLTYEQRWAFIHKLYD | SEQ ID NO:8 |
| BM10129 | EQHDAAHEIRWLPNLTYDQRVAFIRKLHD | SEQ ID NO:9 |
| BM10141 | ENQGAAHEIRWLPNLTWDQRVAFIRKLQD | SEQ ID NO:10 |
| BM10156 | ERTQASHEIRWLPNLTYDQRVAFINKLRD | SEQ ID NO:11 |
| BM10127 | ERKDAGHEIRWLPNLTFDQRSAFIKKLED | SEQ ID NO:12 |
| BM07909 | ERQEAAHEIRWLPNLTFDQRVAFIVKLLD | SEQ ID NO:13 |
| BM10152 | EEDVAAHEIRWLPNLTFNQRAAFIDKLLD | SEQ ID NO:14 |
| BM10145 | ENQDAAHEIRWLPNLTYDQRVAFIGKLND | SEQ ID NO:15 |
| BM10161 | ESGYAVHEIRWLPNLTFDQRVAFINKLQD | SEQ ID NO:16 |
| BM13573 | ESKDAAHEIRWLPNLTFDQRVAFIHKLRD | SEQ ID NO:17 |
| BM13574 | EKKEAAHEIRWLPNLTFDQRVAFIHKLRD | SEQ ID NO:18 |
| BM13577 | EWHQAAHEIRWLPNLTFDQRVAFIHKLRD | SEQ ID NO:19 |
| BM13578 | EWTDAAHEIRWLPNLTFDQRVAFIHKLRD | SEQ ID NO:20 |
| BM13579 | EISAASHEIRWLPNLTFDQRVAFIHKLRD | SEQ ID NO:21 |
| BM13581 | EQQAAAHEIRWLPNLTFDQRVAFIHKLRD | SEQ ID NO:22 |
| BM13583 | ELEKAGHEIRWLPNLTFDQRVAFIHKLRD | SEQ ID NO:23 |
| BM13585 | EYLDAAHEIRWLPNLTFDQRVAFIHKLRD | SEQ ID NO:24 |
| BM13586 | ELKDAGHEIRWLPNLTFDQRVAFIHKLRD | SEQ ID NO:25 |
| BM13587 | EHVDAAHEIRWLPNLTFDQRVAFIHKLRD | SEQ ID NO:26 |
| BM13588 | EYAAAAHEIRWLPNLTFDQRVAFIHKLRD | SEQ ID NO:27 |
| BM13592 | EVDIAAHEIRWLPNLTFDQRVAFIHKLRD | SEQ ID NO:28 |

Figure 1B

| Designation | Sequence | SEQ ID NO: |
|---|---|---|
| BM13594 | EIDEAKHEIRWLPNLTFDQRVAFIHKLDD | SEQ ID NO:29 |
| BM13596 | ELRQAGHEIRWLPNLTFDQRVAFIHKLRD | SEQ ID NO:30 |
| BM13597 | ELQSAAHEIRWLPNLTFDQRVAFIHKLKD | SEQ ID NO:31 |
| BM13598 | ELEKAAHEIRWLPNLTFDQRVAFIHKLRD | SEQ ID NO:32 |
| BM13600 | EAHEAAHEIRWLPNLTFDQRVAFIHKLRD | SEQ ID NO:33 |
| BM13604 | ELQAASHEIRWLPNLTFDQRVAFIHKLRD | SEQ ID NO:34 |
| BM13605 | EIESAKHEIRWLPNLTFDQRVAFIHKLND | SEQ ID NO:35 |
| BM13609 | EWKVAAHEIRWLPNLTFDQRVAFIHKLRD | SEQ ID NO:36 |
| BM13611 | EWKAAAHEIRWLPNLTFDQRVAFIHKLRD | SEQ ID NO:37 |
| BM13612 | EIDLAKHEIRWLPNLTFDQRVAFIHKLDD | SEQ ID NO:38 |
| BM13613 | ELEAARHEIRWLPNLTFDQRVAFIHKLND | SEQ ID NO:39 |
| BM13615 | EAATAGHEIRWLPNLTFDQRVAFIHKLRD | SEQ ID NO:40 |
| BM13616 | EWQQAAHEIRWLPNLTFDQRVAFIHKLRD | SEQ ID NO:41 |
| BM13617 | EADQAGHEIRWLPNLTFDQRVAFIHKLRD | SEQ ID NO:42 |
| BM13620 | EQSKAAHEIRWLPNLTFDQRVAFIHKLDD | SEQ ID NO:43 |
| BM13621 | EADAAGHEIRWLPNLTFDQRVAFIHKLRD | SEQ ID NO:44 |
| BM13622 | EFMDAGHEIRWLPNLTFDQRVAFIHKLRD | SEQ ID NO:45 |
| BM13624 | ESKQAAHEIRWLPNLTFDQRVAFIHKLRD | SEQ ID NO:46 |
| BM13625 | EVSDAAHEIRWLPNLTFDQRVAFIHKLRD | SEQ ID NO:47 |
| BM13626 | EADSASHEIRWLPNLTFDQRVAFIHKLRD | SEQ ID NO:48 |
| BM13627 | ELMEAAHEIRWLPNLTFDQRVAFIHKLRD | SEQ ID NO:49 |
| BM13628 | ELNTAAHEIRWLPNLTFDQRVAFIHKLRD | SEQ ID NO:50 |
| BM13629 | EVHEAGHEIRWLPNLTFDQRVAFIHKLRD | SEQ ID NO:51 |
| BM13633 | ESTAAAHEIRWLPNLTFDQRVAFIHKLRD | SEQ ID NO:52 |
| BM13634 | EWYNAAHEIRWLPNLTFDQRVAFIHKLRD | SEQ ID NO:53 |
| BM13635 | EWNDAAHEIRWLPNLTFDQRVAFIHKLRD | SEQ ID NO:54 |
| BM13637 | EVEVAKHEIRWLPNLTFDQRVAFIHKLRD | SEQ ID NO:55 |
| BM13638 | EFNFAAHEIRWLPNLTFDQRVAFIHKLRD | SEQ ID NO:56 |

Figure 1C

| Designation | Sequence | SEQ ID NO: |
|---|---|---|
| BM13639 | EHDSAAHEIRWLPNLTFDQRVAFIHKLRD | SEQ ID NO:57 |
| BM13640 | EWMDAAHEIRWLPNLTFDQRVAFIHKLRD | SEQ ID NO:58 |
| BM13641 | EFSAAGHEIRWLPNLTFDQRVAFIHKLRD | SEQ ID NO:59 |
| BM13644 | ELNSAAHEIRWLPNLTFDQRVAFIHKLRD | SEQ ID NO:60 |
| BM13645 | EVDTAAHEIRWLPNLTFDQRVAFIHKLRD | SEQ ID NO:61 |
| BM13648 | ESQIAGHEIRWLPNLTFDQRVAFIHKLRD | SEQ ID NO:62 |
| BM13651 | EVSAASHEIRWLPNLTFDQRVAFIHKLRD | SEQ ID NO:63 |
| BM13652 | EDQDAAHEIRWLPNLTFDQRVAFIHKLRD | SEQ ID NO:64 |
| BM13654 | ELEAAKHEIRWLPNLTFDQRVAFIHKLDD | SEQ ID NO:65 |
| BM13655 | ESKRAAHEIRWLPNLTFDQRVAFIHKLRD | SEQ ID NO:66 |
| BM13656 | EYVKAGHEIRWLPNLTFDQRVAFIRKLRD | SEQ ID NO:67 |
| BM13657 | EFSRAGHEIRWLPNLTFDQRVAFIHKLRD | SEQ ID NO:68 |
| BM13659 | EWQFAAHEIRWLPNLTFDQRVAFIHKLRD | SEQ ID NO:69 |
| BM13663 | EWQIAAHEIRWLPNLTFDQRVAFIHKLRD | SEQ ID NO:70 |
| BM13664 | ELQEAAHEIRWLPNLTFDQRVAFIHKLRD | SEQ ID NO:71 |
| BM13667 | EYRAAAHEIRWLPNLTFDQRVAFIHKLRD | SEQ ID NO:72 |
| BM13669 | ELASAGHEIRWLPNLTFDQRVAFIHKLRD | SEQ ID NO:73 |
| BM13672 | EVQSASHEIRWLPNLTFDQRVAFIHKLRD | SEQ ID NO:74 |
| BM13674 | EIEDAGHEIRWLPNLTFDQRVAFIHKLRD | SEQ ID NO:75 |
| BM13675 | ENQAAAHEIRWLPNLTFDQRVAFIHKLRD | SEQ ID NO:76 |
| BM13676 | EATSAGHEIRWLPNLTFDQRVAFIVKLRD | SEQ ID NO:77 |
| BM13678 | EDEQAAHEIRWLPNLTFDQRVAFIHKLRD | SEQ ID NO:78 |
| BM13684 | EQNQAGHEIRWLPNLTFDQRVAFIHKLRD | SEQ ID NO:79 |
| BM13688 | EYTSAAHEIRWLPNLTFDQRVAFIHKLRD | SEQ ID NO:80 |
| BM13691 | EWDAAAHEIRWLPNLTFDQRVAFIHKLRD | SEQ ID NO:81 |
| BM13692 | EEMQAGHEIRWLPNLTFDQRVAFIHKLRD | SEQ ID NO:82 |
| BM13694 | ELSDAAHEIRWLPNLTFDQRVAFIHKLND | SEQ ID NO:83 |
| BM13695 | EIDAAKHEIRWLPNLTFDQRVAFIHKLDD | SEQ ID NO:84 |

Figure 1D

| Designation | Sequence | SEQ ID NO: |
|---|---|---|
| BM13697 | EAERAGHEIRWLPNLTFDQRVAFIRKLRD | SEQ ID NO:85 |
| BM13706 | EEDSAAHEIRWLPNLTFDQRVAFIHKLKD | SEQ ID NO:86 |
| BM13708 | EQKAAGHEIRWLPNLTFDQRVAFIHKLRD | SEQ ID NO:87 |
| BM13710 | EWDQAAHEIRWLPNLTFDQRVAFIHKLRD | SEQ ID NO:88 |
| BM13711 | EAKAAAHEIRWLPNLTFDQRVAFIHKLRD | SEQ ID NO:89 |
| BM13714 | ELSEAAHEIRWLPNLTFDQRVAFIHKLKD | SEQ ID NO:90 |
| BM13716 | ETEAAKHEIRWLPNLTFDQRVAFIHKLDD | SEQ ID NO:91 |
| BM13719 | EAKSAAHEIRWLPNLTFDQRVAFIHKLRD | SEQ ID NO:92 |
| BM13720 | EQSAAAHEIRWLPNLTFDQRVAFIHKLND | SEQ ID NO:93 |
| BM13721 | EKERAAHEIRWLPNLTFDQRVAFIHKLRD | SEQ ID NO:94 |
| BM13725 | EWDEAAHEIRWLPNLTFDQRVAFIHKLKD | SEQ ID NO:95 |
| BM13727 | EEKDAAHEIRWLPNLTFDQRVAFIHKLRD | SEQ ID NO:96 |
| BM13728 | EIENAAHEIRWLPNLTFDQRVAFIWKLRD | SEQ ID NO:97 |
| BM13732 | ETKEAAHEIRWLPNLTFDQRVAFIHKLWD | SEQ ID NO:98 |
| BM13735 | ELEAAKHEIRWLPNLTFDQRVAFIHKLND | SEQ ID NO:99 |
| BM13736 | EWAEAAHEIRWLPNLTFDQRVAFIHKLRD | SEQ ID NO:100 |
| BM13740 | ESQEAGHEIRWLPNLTFDQRVAFIHKLRD | SEQ ID NO:101 |
| BM13742 | ELSTAAHEIRWLPNLTFDQRVAFIHKLRD | SEQ ID NO:102 |
| BM13747 | EIEEAGHEIRWLPNLTFDQRVAFIHKLRD | SEQ ID NO:103 |
| BM13749 | ELQTASHEIRWLPNLTFDQRVAFIHKLRD | SEQ ID NO:104 |
| BM13750 | EQDSAAHEIRWLPNLTFDQRVAFIHKLRD | SEQ ID NO:105 |
| BM13751 | ESASAGHEIRWLPNLTFDQRVAFIHKLRD | SEQ ID NO:106 |
| BM13752 | EVAKASHEIRWLPNLTFDQRVAFIHKLRD | SEQ ID NO:107 |
| BM13758 | EVQEAAAHEIRWLPNLTFDQRVAFIHKLWD | SEQ ID NO:108 |
| BM13759 | ESYEAAHEIRWLPNLTFDQRVAFIHKLRD | SEQ ID NO:109 |
| BM13760 | ETAEAGHEIRWLPNLTFDQRVAFIHKLRD | SEQ ID NO:110 |
| BM13761 | ELEEAAHEIRWLPNLTFDQRVAFIHKLRD | SEQ ID NO:111 |
| BM13771 | EAAAAGHEIRWLPNLTFDQRVAFIHKLRD | SEQ ID NO:112 |

Figure 1E

| Designation | Sequence | SEQ ID NO: |
|---|---|---|
| BM13773 | EYVDAGHEIRWLPNLTFDQRVAFIRKLRD | SEQ ID NO:113 |
| BM13776 | EIQEAGHEIRWLPNLTFDQRVAFIHKLRD | SEQ ID NO:114 |
| BM13777 | ESATAAHEIRWLPNLTFDQRVAFIHKLRD | SEQ ID NO:115 |
| BM13780 | EWMSAAHEIRWLPNLTFDQRVAFIHKLRD | SEQ ID NO:116 |
| BM13782 | EREQASHEIRWLPNLTFDQRVAFIHKLRD | SEQ ID NO:117 |
| BM13783 | EIEQAGHEIRWLPNLTFDQRVAFIHKLRD | SEQ ID NO:118 |
| BM13786 | EHNAAAHEIRWLPNLTFDQRVAFIHKLRD | SEQ ID NO:119 |
| BM13792 | EIEVAAHEIRWLPNLTFDQRVAFIHKLRD | SEQ ID NO:120 |
| BM13796 | ERAEAAHEIRWLPNLTFDQRVAFIHKLRD | SEQ ID NO:121 |
| BM13799 | ESELAAHEIRWLPNLTFDQRVAFIWKLRD | SEQ ID NO:122 |
| BM13806 | EYRAAGHEIRWLPNLTFDQRVAFIHKLRD | SEQ ID NO:123 |
| BM13808 | ETANAAHEIRWLPNLTFDQRVAFIHKLRD | SEQ ID NO:124 |
| BM13811 | EWYEAAHEIRWLPNLTFDQRVAFIHKLRD | SEQ ID NO:125 |
| BM13812 | EEQEAAHEIRWLPNLTFDQRVAFIHKLWD | SEQ ID NO:126 |
| BM13823 | EHDDAAHEIRWLPNLTFDQRVAFIHKLRD | SEQ ID NO:127 |
| BM13824 | EWYSAAHEIRWLPNLTFDQRVAFIHKLRD | SEQ ID NO:128 |
| BM13838 | EISDAAHEIRWLPNLTFDQRVAFIHKLRD | SEQ ID NO:129 |
| BM13840 | EYTTAAHEIRWLPNLTFDQRVAFIHKLRD | SEQ ID NO:130 |
| BM13842 | EISQAAHEIRWLPNLTFDQRVAFIHKLRD | SEQ ID NO:131 |
| BM13845 | ENDDAAHEIRWLPNLTFDQRVAFIHKLRD | SEQ ID NO:132 |
| BM13846 | ESEIAGHEIRWLPNLTFDQRVAFIRKLRD | SEQ ID NO:133 |
| BM13848 | EQADAAHEIRWLPNLTFDQRVAFIHKLRD | SEQ ID NO:134 |
| BM13849 | ETESAAHEIRWLPNLTFDQRVAFIHKLRD | SEQ ID NO:135 |
| BM13860 | EISDAKHEIRWLPNLTFDQRVAFIHKLDD | SEQ ID NO:136 |
| BM13865 | EHLNAAHEIRWLPNLTFDQRVAFIHKLRD | SEQ ID NO:137 |
| BM13866 | EWLDAAHEIRWLPNLTFDQRVAFIHKLRD | SEQ ID NO:138 |
| BM13875 | ENAAAAHEIRWLPNLTFDQRVAFIHKLRD | SEQ ID NO:139 |
| BM13879 | EAELAGHEIRWLPNLTFDQRVAFIRKLRD | SEQ ID NO:140 |

Figure 1F

| Designation | Sequence | SEQ ID NO: |
|---|---|---|
| BM13480 | EVTDAGHEIRWLPNLTFDQRVAFIEKLKD | SEQ ID NO:141 |
| BM13481 | ELDSASHEIRWLPNLTFDQRVAFINKLLD | SEQ ID NO:142 |
| BM13482 | EINLAKHEIRWLPNLTFDQRVAFIEKLND | SEQ ID NO:143 |
| BM13483 | ESEVAKHEIRWLPNLTFDQRVAFIHKLSD | SEQ ID NO:144 |
| BM13484 | ESAEAGHEIRWLPNLTFDQRVAFIHKLQD | SEQ ID NO:145 |
| BM13485 | EYSNAAHEIRWLPNLTFDQRVAFIDKLSD | SEQ ID NO:146 |
| BM13487 | ETNNAGHEIRWLPNLTFDQRVAFIIKLRD | SEQ ID NO:147 |
| BM13488 | EVEFAAHEIRWLPNLTFDQRVAFIHKLND | SEQ ID NO:148 |
| BM13489 | EVELAGHEIRWLPNLTFDQRVAFIEKLHD | SEQ ID NO:149 |
| BM13490 | EVLKASHEIRWLPNLTFDQRVAFITKLQD | SEQ ID NO:150 |
| BM13491 | EIANAGHEIRWLPNLTFDQRVAFIHKLDD | SEQ ID NO:151 |
| BM13493 | EYMKAGHEIRWLPNLTFDQRVAFTVKLRD | SEQ ID NO:152 |
| BM13495 | EHANAQHEIRWLPNLTFDQRVAFIHKLQD | SEQ ID NO:153 |
| BM13496 | EVDIASHEIRWLPNLTYDQRVAFTWKLRD | SEQ ID NO:154 |
| BM13497 | EEVFAAHEIRWLPNLTFDQRVAFIVKLRD | SEQ ID NO:155 |
| BM13499 | EFNTAAHEIRWLPNLTFDQRVAFIRKLDD | SEQ ID NO:156 |
| BM13501 | EVDVAGHEIRWLPNLTFDQRVAFIHKLND | SEQ ID NO:157 |
| BM13502 | EWSLAAHEIRWLPNLTFDQRVAFTVKLRD | SEQ ID NO:158 |
| BM13503 | ELDDAAHEIRWLPNLTFDQRVAFIQKLQD | SEQ ID NO:159 |
| BM13505 | ERHEAGHEIRWLPNLTFDQRVAFIRKLND | SEQ ID NO:160 |
| BM13506 | EISDAIHEIRWLPNLTFDQRVAFIHKLQD | SEQ ID NO:161 |
| BM13507 | EWETAGHEIRWLPNLTFDQRVAFTVKLSD | SEQ ID NO:162 |
| BM13508 | ERYWASHEIRWLPNLTFDQRVAFIHKLND | SEQ ID NO:163 |
| BM13512 | EIDWAGHEIRWLPNLTFDQRVAFIHKLLD | SEQ ID NO:164 |
| BM13515 | EQSKAGHEIRWLPNLTFDQRVAFIHKLKD | SEQ ID NO:165 |
| BM13518 | EIEAAQHEIRWLPNLTFDQRVAFIHKLRD | SEQ ID NO:166 |
| BM13519 | EHEQAAHEIRWLPNLTFDQRVAFIRKLVD | SEQ ID NO:167 |
| BM13520 | EAEQAGHEIRWLPNLTFDQRVAFINKLQD | SEQ ID NO:168 |

Figure 1G

| Designation | Sequence | SEQ ID NO: |
|---|---|---|
| BM13522 | EVDYAAHEIRWLPNLTFDQRVAFIHKLWD | SEQ ID NO:169 |
| BM13525 | EYSAAGHEIRWLPNLTFDQRVAFIEKLRD | SEQ ID NO:170 |
| BM13561 | ELATASHEIRWLPNLTFDQRVAFIHKLRD | SEQ ID NO:171 |
| BM13572 | EYRVAGHEIRWLPNLTFDQRVAFIQKLRD | SEQ ID NO:172 |
| BM13575 | EVVSAKHEIRWLPNLTFDQRVAFIHKLDD | SEQ ID NO:173 |
| BM13576 | ESAQAAHEIRWLPNLTFDQRVAFIRKLRD | SEQ ID NO:174 |
| BM13584 | EYSAAGHEIRWLPNLTFDQRVAFIHKLRD | SEQ ID NO:175 |
| BM13589 | EQKEAAAEIRWLPNLTFDQRVAFIHKLRD | SEQ ID NO:176 |
| BM13590 | EAAIAGKEIRWLPNLTFDQRVAFIHKLRD | SEQ ID NO:177 |
| BM13591 | EISKAKHEIRWLPNLTFDQRVAFIHKLDD | SEQ ID NO:178 |
| BM13593 | ESVAAAHEIRWLPNLTFDQRVAFIWKLRD | SEQ ID NO:179 |
| BM13595 | EIQQAKHEIRWLPNLTFDQRVAFIRKLDD | SEQ ID NO:180 |
| BM13599 | EITSAKHEIRWLPNLTFDQRVAFIHKLRD | SEQ ID NO:181 |
| BM13601 | EQDVAAHEIRWLPNLTFDQRVAFIRKLRD | SEQ ID NO:182 |
| BM13603 | ELERAAHEIRWLPNLTFDQRVAFINKLRD | SEQ ID NO:183 |
| BM13607 | ENQLAAHEIRWLPNLTFDQRVAFIHKLDD | SEQ ID NO:184 |
| BM13608 | EISQAKHEIRWLPNLTFDQRVAFIHKLRD | SEQ ID NO:185 |
| BM13610 | EIANASHEIRWLPNLTFDQRVAFIYKLRD | SEQ ID NO:186 |
| BM13614 | EWQAAAHEIRWLPNLTFDQRVAFIRKLRD | SEQ ID NO:187 |
| BM13618 | ERKDAGHEIRWLPNLTFDQRVAFIRKLDD | SEQ ID NO:188 |
| BM13619 | EITQAKHEIRWLPNLTFDQRVAFIHKLDD | SEQ ID NO:189 |
| BM13623 | EFTQAGHEIRWLPNLTFDQRVAFIHKLRD | SEQ ID NO:190 |
| BM13630 | EWNTASHEIRWLPNLTFDQRVAFIHKLRD | SEQ ID NO:191 |
| BM13631 | EKFVAAHEIRWLPNLTFDQRVAFIHKLKD | SEQ ID NO:192 |
| BM13632 | EADSAGAEIRWLPNLTFDQRVAFIHKLRD | SEQ ID NO:193 |
| BM13636 | ESSVAAAEIRWLPNLTFDQRVAFIHKLRD | SEQ ID NO:194 |
| BM13642 | EVDLAGREIRWLPNLTFDQRVAFIHKLRD | SEQ ID NO:195 |
| BM13643 | EQERAAAEIRWLPNLTFDQRVAFIHKLRD | SEQ ID NO:196 |

Figure 1H

| Designation | Sequence | SEQ ID NO: |
|---|---|---|
| BM13646 | EIWQAKHEIRWLPNLTFDQRVAFIHKLDD | SEQ ID NO:197 |
| BM13647 | ELNQAKHEIRWLPNLTFDQRVAFIHKLED | SEQ ID NO:198 |
| BM13649 | ELQQASHEIRWLPNLTFDQRVAFIHKLRD | SEQ ID NO:199 |
| BM13650 | EINQAKHEIRWLPNLTFDQRVAFIHKLDD | SEQ ID NO:200 |
| BM13653 | ELVLAGHEIRWLPNLTFDQRVAFIHKLRD | SEQ ID NO:201 |
| BM13658 | ELTSAAHEIRWLPNLTFDQRVAFIHKLRD | SEQ ID NO:202 |
| BM13661 | EWNAAAREIRWLPNLTFDQRVAFIHKLRD | SEQ ID NO:203 |
| BM13662 | EILHAKHEIRWLPNLTFDQRVAFIHKLRD | SEQ ID NO:204 |
| BM13665 | EVLTAKHEIRWLPNLTFDQRVAFIHKLND | SEQ ID NO:205 |
| BM13666 | ENSKAAHEIRWLPNLTFDQRVAFIHKLAD | SEQ ID NO:206 |
| BM13668 | EVMTAKHEIRWLPNLTFDQRVAFIHKLDD | SEQ ID NO:207 |
| BM13671 | EARDAAHEIRWLPNLTFDQRVAFIHKLRD | SEQ ID NO:208 |
| BM13673 | ERSKAAHEIRWLPNLTFDQRVAFIHKLSD | SEQ ID NO:209 |
| BM13677 | EIYSAKHEIRWLPNLTFDQRVAFIHKLKD | SEQ ID NO:210 |
| BM13679 | EVQSAKHEIRWLPNLTFDQRVAFIHKLRD | SEQ ID NO:211 |
| BM13680 | ETLEAAHEIRWLPNLTFDQRVAFIHKLKD | SEQ ID NO:212 |
| BM13681 | EQMRAAHEIRWLPNLTFDQRVAFIRKLRD | SEQ ID NO:213 |
| BM13685 | ENKNAAHEIRWLPNLTFDQRVAFIHKLRD | SEQ ID NO:214 |
| BM13687 | ETESAKHEIRWLPNLTFDQRVAFIHKLTD | SEQ ID NO:215 |
| BM13689 | ETVQAKHEIRWLPNLTFDQRVAFIHKLDD | SEQ ID NO:216 |
| BM13693 | EIASAKHEIRWLPNLTFDQRVAFIHKLRD | SEQ ID NO:217 |
| BM13698 | EVMDAKHEIRWLPNLTFDQRVAFIHKLRD | SEQ ID NO:218 |
| BM13699 | ETDAAKHEIRWLPNLTFDQRVAFIHKLRD | SEQ ID NO:219 |
| BM13701 | ELQIAKHEIRWLPNLTFDQRVAFIHKLRD | SEQ ID NO:220 |
| BM13702 | EWKDAAQEIRWLPNLTFDQRVAFIHKLRD | SEQ ID NO:221 |
| BM13703 | ERDSAAHEIRWLPNLTFDQRVAFIRKLRD | SEQ ID NO:222 |
| BM13704 | EIAAAKHEIRWLPNLTFDQRVAFIHKLRD | SEQ ID NO:223 |
| BM13707 | ESVKAKHEIRWLPNLTFDQRVAFIHKLDD | SEQ ID NO:224 |

Figure 1I

| Designation | Sequence | SEQ ID NO: |
|---|---|---|
| BM13709 | ENERAKHEIRWLPNLTFDQRVAFIHKLDD | SEQ ID NO:225 |
| BM13712 | EYKRAGHEIRWLPNLTFDQRVAFIRKLRD | SEQ ID NO:226 |
| BM13713 | EVRAASHEIRWLPNLTFDQRVAFIHKLRD | SEQ ID NO:227 |
| BM13717 | EDKRAAHEIRWLPNLTFDQRVAFIRKLRD | SEQ ID NO:228 |
| BM13718 | ESEKAGKEIRWLPNLTFDQRVAFIRKLRD | SEQ ID NO:229 |
| BM13722 | EINRAKHEIRWLPNLTFDQRVAFIHKLDD | SEQ ID NO:230 |
| BM13724 | ETQQASHEIRWLPNLTFDQRVAFIHKLRD | SEQ ID NO:231 |
| BM13729 | ENQSAAHEIRWLPNLTFDQRVAFIHKLRD | SEQ ID NO:232 |
| BM13730 | EAKQASHEIRWLPNLTFDQRVAFIVKLRD | SEQ ID NO:233 |
| BM13731 | EAAQAAHEIRWLPNLTFDQRVAFIHKLRD | SEQ ID NO:234 |
| BM13733 | EVQYASHEIRWLPNLTFDQRVAFIHKLRD | SEQ ID NO:235 |
| BM13734 | ELRNAAHEIRWLPNLTFDQRVAFIHKLDD | SEQ ID NO:236 |
| BM13737 | EQRAAAHEIRWLPNLTFDQRVAFIHKLRD | SEQ ID NO:237 |
| BM13739 | EASEAAAEIRWLPNLTFDQRVAFIHKLRD | SEQ ID NO:238 |
| BM13741 | ESVIAAHEIRWLPNLTFDQRVAFIHKLRD | SEQ ID NO:239 |
| BM13744 | EILRAKHEIRWLPNLTFDQRVAFIHKLRD | SEQ ID NO:240 |
| BM13746 | ESKTAAHEIRWLPNLTFDQRVAFIQKLRD | SEQ ID NO:241 |
| BM13748 | ELAEASHEIRWLPNLTFDQRVAFIHKLFD | SEQ ID NO:242 |
| BM13753 | EATTAKHEIRWLPNLTFDQRVAFIHKLRD | SEQ ID NO:243 |
| BM13754 | EIENAAHEIRWLPNLTFDQRVAFIHKLRD | SEQ ID NO:244 |
| BM13755 | EAKDAAHEIRWLPNLTFDQRVAFIRKLRD | SEQ ID NO:245 |
| BM13757 | ERLEAAAEIRWLPNLTFDQRVAFIHKLRD | SEQ ID NO:246 |
| BM13762 | EQMEAAAEIRWLPNLTFDQRVAFIHKLRD | SEQ ID NO:247 |
| BM13763 | EVKTASHEIRWLPNLTFDQRVAFIRKLRD | SEQ ID NO:248 |
| BM13764 | ESFEASHEIRWLPNLTFDQRVAFIQKLRD | SEQ ID NO:249 |
| BM13765 | EIKSAKHEIRWLPNLTFDQRVAFIHKLDD | SEQ ID NO:250 |
| BM13766 | EIKNAKHEIRWLPNLTFDQRVAFIHKLDD | SEQ ID NO:251 |
| BM13768 | ELQEAKHEIRWLPNLTFDQRVAFIHKLDD | SEQ ID NO:252 |

Figure 1J

| Designation | Sequence | SEQ ID NO: |
|---|---|---|
| BM13769 | ERQNAAHEIRWLPNLTFDQRVAFIRKLRD | SEQ ID NO:253 |
| BM13770 | EVLQAKHEIRWLPNLTFDQRVAFIHKLDD | SEQ ID NO:254 |
| BM13772 | EANVASHEIRWLPNLTFDQRVAFIHKLRD | SEQ ID NO:255 |
| BM13774 | ELDAAKHEIRWLPNLTFDQRVAFIHKLDD | SEQ ID NO:256 |
| BM13775 | ETASAAHEIRWLPNLTFDQRVAFIHKLND | SEQ ID NO:257 |
| BM13778 | EWKQAASEIRWLPNLTFDQRVAFIHKLRD | SEQ ID NO:258 |
| BM13779 | ETASASHEIRWLPNLTFDQRVAFIHKLQD | SEQ ID NO:259 |
| BM13781 | ESIVAGHEIRWLPNLTFDQRVAFIHKLRD | SEQ ID NO:260 |
| BM13784 | EIKQAKHEIRWLPNLTFDQRVAFIHKLDD | SEQ ID NO:261 |
| BM13785 | EQATASHEIRWLPNLTFDQRVAFIHKLRD | SEQ ID NO:262 |
| BM13787 | ELNAAKHEIRWLPNLTFDQRVAFIHKLDD | SEQ ID NO:263 |
| BM13788 | EVKRAGHEIRWLPNLTFDQRVAFIRKLRD | SEQ ID NO:264 |
| BM13789 | ESRNAAHEIRWLPNLTFDQRVAFIHKLQD | SEQ ID NO:265 |
| BM13791 | ESITASAEIRWLPNLTFDQRVAFIRKLRD | SEQ ID NO:266 |
| BM13793 | EAATAAHEIRWLPNLTFDQRVAFIHKLQD | SEQ ID NO:267 |
| BM13794 | EVYAAKHEIRWLPNLTFDQRVAFIHKLDD | SEQ ID NO:268 |
| BM13795 | EISRAKHEIRWLPNLTFDQRVAFIHKLRD | SEQ ID NO:269 |
| BM13798 | EYVTAAHEIRWLPNLTFDQRVAFIRKLRD | SEQ ID NO:270 |
| BM13800 | EHIDAGHEIRWLPNLTFDQRVAFIHKLRD | SEQ ID NO:271 |
| BM13801 | EILQAKHEIRWLPNLTFDQRVAFIHKLND | SEQ ID NO:272 |
| BM13802 | ENSQAKHEIRWLPNLTFDQRVAFIHKLND | SEQ ID NO:273 |
| BM13803 | EYRVAAKEIRWLPNLTFDQRVAFIRKLRD | SEQ ID NO:274 |
| BM13804 | EIYNAGHEIRWLPNLTFDQRVAFIHKLRD | SEQ ID NO:275 |
| BM13805 | ESNEAAAEIRWLPNLTFDQRVAFIHKLRD | SEQ ID NO:276 |
| BM13809 | ESQLAAAEIRWLPNLTFDQRVAFIRKLRD | SEQ ID NO:277 |
| BM13810 | ELKEAGHEIRWLPNLTFDQRVAFIHKLQD | SEQ ID NO:278 |
| BM13813 | ETRVASVEIRWLPNLTFDQRVAFIQKLND | SEQ ID NO:279 |
| BM13818 | ELRTAAHEIRWLPNLTFDQRVAFIHKLND | SEQ ID NO:280 |

Figure 1K

| Designation | Sequence | SEQ ID NO: |
|---|---|---|
| BM13820 | EKTYAHFEIRWLPNLTFDQRVAFISKLWD | SEQ ID NO:281 |
| BM13821 | EEAQASHEIRWLPNLTFDQRVAFIHKLRD | SEQ ID NO:282 |
| BM13822 | EITSAAHEIRWLPNLTFDQRVAFIHKLRD | SEQ ID NO:283 |
| BM13825 | EVKTASHEIRWLPNLTFDQRVAFIHKLKD | SEQ ID NO:284 |
| BM13826 | ETKVAAHEIRWLPNLTFDQRVAFIHKLRD | SEQ ID NO:285 |
| BM13829 | EDLVAQHEIRWLPNLTFDQRVAFIRKLRD | SEQ ID NO:286 |
| BM13830 | ETQTAFNEIRWLPNLTYDQRAAFILKLWD | SEQ ID NO:287 |
| BM13831 | EIKDAGHEIRWLPNLTFDQRVAFIRKLRD | SEQ ID NO:288 |
| BM13836 | EYKEAGHEIRWLPNLTYDQRVAFIVKLRD | SEQ ID NO:289 |
| BM13839 | EAALAAHEIRWLPNLTFDQRVAFIHKLKD | SEQ ID NO:290 |
| BM13843 | EQERAAHEIRWLPNLTFDQRVAFIRKLRD | SEQ ID NO:291 |
| BM13844 | EWFDAAHEIRWLPNLTFDQRVAFIRKLRD | SEQ ID NO:292 |
| BM13847 | EIIQAKHEIRWLPNLTFDQRVAFIHKLDD | SEQ ID NO:293 |
| BM13850 | ELTNAKHEIRWLPNLTFDQRVAFIHKLDD | SEQ ID NO:294 |
| BM13851 | EIQLAKHEIRWLPNLTFDQRVAFIHKLDD | SEQ ID NO:295 |
| BM13854 | EIHDAKHEIRWLPNLTFDQRVAFIHKLQD | SEQ ID NO:296 |
| BM13869 | EVKIASHEIRWLPNLTFDQRVAFIHKLRD | SEQ ID NO:297 |
| BM13870 | EQHSAAHEIRWLPNLTFDQRVAFIRKLRD | SEQ ID NO:298 |
| BM13872 | EVFAASAEIRWLPNLTFDQRVAFIHKLRD | SEQ ID NO:299 |
| BM13874 | ETDLAGHEIRWLPNLTFDQRVAFIRKLRD | SEQ ID NO:300 |
| BM13877 | EANFAGHEIRWLPNLTFDQRVAFIRKLRD | SEQ ID NO:301 |
| BM13878 | EFETAGHEIRWLPNLTFDQRVAFITKLWD | SEQ ID NO:302 |
| BM13880 | EVNLAKHEIRWLPNLTFDQRVAFIHKLDD | SEQ ID NO:303 |
| BM13881 | EADTAAHEIRWLPNLTFDQRVAFIYKLRD | SEQ ID NO:304 |
| BM13882 | EFVDAGHEIRWLPNLTFDQRVAFIQKLRD | SEQ ID NO:305 |
| BM13883 | EDHKAEHEIRWLPNLTFDQRVAFIHKLRD | SEQ ID NO:306 |
| BM13884 | ETVDAGHEIRWLPNLTFDQRVAFIHKLAD | SEQ ID NO:307 |
| BM13885 | ESQRAGHEIRWLPNLTFDQRVAFITKLRD | SEQ ID NO:308 |

Figure 1L

| Designation | Sequence | SEQ ID NO: |
|---|---|---|
| BM13886 | EWSSAAHEIRWLPNLTFDQRVAFIHKLQD | SEQ ID NO:309 |
| BM13887 | EVAVAGHEIRWLPNLTYDQRVAFIVKLRD | SEQ ID NO:310 |
| BM13888 | ESAEAGHEIRWLPNLTFDQRVAFIEKLRD | SEQ ID NO:311 |
| BM13889 | EAVAAGHEIRWLPNLTFDQRVAFIHKLND | SEQ ID NO:312 |
| BM13890 | EFQIAGHEIRWLPNLTFDQRVAFINKLRD | SEQ ID NO:313 |
| BM13891 | ELMVAKHEIRWLPNLTFDQRVAFIHKLDD | SEQ ID NO:314 |
| BM13892 | EYDSAAHEIRWLPNLTYDQRVAFILKLRD | SEQ ID NO:315 |
| BM13893 | EVLEAKHEIRWLPNLTFDQRVAFIHKLDD | SEQ ID NO:316 |
| BM13894 | ESIAASHEIRWLPNLTFDQRVAFIHKLRD | SEQ ID NO:317 |
| BM13895 | EVAEAGHEIRWLPNLTFDQRVAFISKLRD | SEQ ID NO:318 |
| BM13896 | EQAKAAHEIRWLPNLTFDQRVAFIHKLND | SEQ ID NO:319 |
| BM13897 | ERDDAAHEIRWLPNLTFDQRVAFIEKLRD | SEQ ID NO:320 |
| BM13898 | EAKDASHEIRWLPNLTFDQRVAFIHKLRD | SEQ ID NO:321 |
| BM13899 | EASSAAHEIRWLPNLTFDQRVAFIQKLRD | SEQ ID NO:322 |
| BM13900 | EWMEASHEIRWLPNLTYDQRVAFIVKLRD | SEQ ID NO:323 |
| BM13901 | EQKNAAHEIRWLPNLTFDQRVAFIEKLRD | SEQ ID NO:324 |
| BM13902 | EIENAKHEIRWLPNLTFDQRVAFIHKLDD | SEQ ID NO:325 |
| BM13903 | EVNRASHEIRWLPNLTFDQRVAFIHKLLD | SEQ ID NO:326 |
| BM13904 | ERLLAGHEIRWLPNLTFDQRVAFINKLRD | SEQ ID NO:327 |
| BM13906 | EVSIAGHEIRWLPNLTFDQRVAFIRKLRD | SEQ ID NO:328 |
| BM13907 | EKEVAAHEIRWLPNLTFDQRVAFIHKLRD | SEQ ID NO:329 |
| BM13908 | ESERASHEIRWLPNLTFDQRVAFIHKLRD | SEQ ID NO:330 |
| BM13909 | EWNEAAHEIRWLPNLTFDQRVAFIHKLRD | SEQ ID NO:331 |
| BM13910 | ENVDAAHEIRWLPNLTFDQRVAFIHKLRD | SEQ ID NO:332 |
| BM13911 | EADAASHEIRWLPNLTFDQRVAFIRKLRD | SEQ ID NO:333 |
| BM13912 | ELESASHEIRWLPNLTFDQRVAFIHKLID | SEQ ID NO:334 |
| BM13913 | EEQLAAHEIRWLPNLTFDQRVAFIRKLRD | SEQ ID NO:335 |
| BM13914 | EFELAGHEIRWLPNLTFDQRVAFIHKLDD | SEQ ID NO:336 |

Figure 1M

| Designation | Sequence | SEQ ID NO: |
|---|---|---|
| BM13915 | EAFVAQHEIRWLPNLTYDQRVAFIVKLRD | SEQ ID NO:337 |
| BM13916 | EALKASHEIRWLPNLTFDQRVAFINKLRD | SEQ ID NO:338 |
| BM13917 | ELERAGHEIRWLPNLTFDQRVAFIKKLTD | SEQ ID NO:339 |
| BM13918 | EVEWAKHEIRWLPNLTFDQRVAFIHKLQD | SEQ ID NO:340 |
| BM13919 | EKASAQHEIRWLPNLTFDQRVAFIHKLDD | SEQ ID NO:341 |
| BM13920 | ETEIAKHEIRWLPNLTFDQRVAFIHKLDD | SEQ ID NO:342 |
| BM13921 | EVNLAAHEIRWLPNLTFDQRVAFIHKLTD | SEQ ID NO:343 |
| BM13922 | EAEEAAHEIRWLPNLTFDQRVAFIHKLRD | SEQ ID NO:344 |
| BM13923 | ETDRAKHEIRWLPNLTFDQRVAFIHKLND | SEQ ID NO:345 |
| BM13925 | EFAQAGHEIRWLPNLTFDQRVAFIHKLKD | SEQ ID NO:346 |
| BM13926 | ETDEASHEIRWLPNLTFDQRVAFIRKLRD | SEQ ID NO:347 |
| BM13927 | ENADAGHEIRWLPNLTFDQRVAFIQKLRD | SEQ ID NO:348 |
| BM13928 | ESTQAAHEIRWLPNLTFDQRVAFIQKLQD | SEQ ID NO:349 |
| BM13929 | EQALAAHEIRWLPNLTFDQRVAFIHKLND | SEQ ID NO:350 |
| BM13930 | EAHAASHEIRWLPNLTFDQRVAFIHKLDD | SEQ ID NO:351 |
| BM13932 | EVDNAGHEIRWLPNLTFDQRVAFIQKLRD | SEQ ID NO:352 |
| BM13993 | EAGRAAHEIRWLPNLTWDQRVAFIWKLRD | SEQ ID NO:353 |
| PP07918 | KEQDAAAHEIRWLPNLTFDQRVAFIHKLADDPSQSSELLSEAKKLNDSQ | SEQ ID NO:354 |
| PP10193 | KEWMRAAHEIRWLPNLTFDQRVAFIHKLEDDPSQSSELLSEAKKLNDSQ | SEQ ID NO:355 |
| PP10109 | KEANTAAHEIRWLPNLTFDQRVAFIRKLWDDPSQSSELLSEAKKLNDSQ | SEQ ID NO:356 |
| PP07960 | KEFESAAHEIRWLPNLTFDQRVAFIHKLSDDPSQSSELLSEAKKLNDSQ | SEQ ID NO:357 |
| PP10140 | KERSAAAHEIRWLPNLTFDQRVAFIKLTDDPSQSSELLSEAKKLNDSQ | SEQ ID NO:358 |
| PP07930 | KESDSAVHEIRWLPNLTFDQRVAFIHKLLDDPSQSSELLSEAKKLNDSQ | SEQ ID NO:359 |
| PP10183 | KEADNAGHEIRWLPNLTFDQRWAFIHKLLDDPSQSSELLSEAKKLNDSQ | SEQ ID NO:360 |
| PP10111 | KEDDTAAHEIRWLPNLTYEQRWAFIHKLYDDPSQSSELLSEAKKLNDSQ | SEQ ID NO:361 |
| PP10129 | KEQHDAAHEIRWLPNLTFDQRVAFIRKLHDDPSQSSELLSEAKKLNDSQ | SEQ ID NO:362 |
| PP10141 | KENQGAAHEIRWLPNLTWDQRVAFIRKLQDDPSQSSELLSEAKKLNDSQ | SEQ ID NO:363 |
| PP10156 | KERTQASHEIRWLPNLTYDQRVAFINKLRDDPSQSSELLSEAKKLNDSQ | SEQ ID NO:364 |

Figure 1N

| Designation | Sequence | SEQ ID NO: |
|---|---|---|
| PP10127 | KERKDAGHEIRWLPNLTFDQRSAFIKKLEDDPSQSSELLSEAKKLNDSQ | SEQ ID NO:365 |
| PP07909 | KERQEAAHEIRWLPNLTFDQRVAFIVKLLDDPSQSSELLSEAKKLNDSQ | SEQ ID NO:366 |
| PP10152 | KEEDVAAHEIRWLPNLTFNQRAAFIDKLLDDPSQSSELLSEAKKLNDSQ | SEQ ID NO:367 |
| PP10145 | KENQDAAHEIRWLPNLTYDQRVAFIGKLNDDPSQSSELLSEAKKLNDSQ | SEQ ID NO:368 |
| PP10161 | KESGYAVHEIRWLPNLTFDQRVAFINKLQDDPSQSSELLSEAKKLNDSQ | SEQ ID NO:369 |
| PP13573 | KESKDAAHEIRWLPNLTFDQRVAFIHKLRDDPSQSSELLSEAKKLNDSQ | SEQ ID NO:370 |
| PP13574 | KEKKEAAHEIRWLPNLTFDQRVAFIHKLRDDPSQSSELLSEAKKLNDSQ | SEQ ID NO:371 |
| PP13577 | KEWHQAAHEIRWLPNLTFDQRVAFIHKLRDDPSQSSELLSEAKKLNDSQ | SEQ ID NO:372 |
| PP13578 | KEWTDAAHEIRWLPNLTFDQRVAFIHKLRDDPSQSSELLSEAKKLNDSQ | SEQ ID NO:373 |
| PP13579 | KEISAASHEIRWLPNLTFDQRVAFIHKLRDDPSQSSELLSEAKKLNDSQ | SEQ ID NO:374 |
| PP13581 | KEQQAAAHEIRWLPNLTFDQRVAFIHKLRDDPSQSSELLSEAKKLNDSQ | SEQ ID NO:375 |
| PP13583 | KELEKAGHEIRWLPNLTFDQRVAFTHKLRDDPSQSSELLSEAKKLNDSQ | SEQ ID NO:376 |
| PP13585 | KEYLDAAHEIRWLPNLTFDQRVAFIHKLRDDPSQSSELLSEAKKLNDSQ | SEQ ID NO:377 |
| PP13586 | KELKDAGHEIRWLPNLTFDQRVAFIHKLRDDPSQSSELLSEAKKLNDSQ | SEQ ID NO:378 |
| PP13587 | KEHVDAAHEIRWLPNLTFDQRVAFIHKLRDDPSQSSELLSEAKKLNDSQ | SEQ ID NO:379 |
| PP13588 | KEYAAAAHEIRWLPNLTFDQRVAFIHKLRDDPSQSSELLSEAKKLNDSQ | SEQ ID NO:380 |
| PP13592 | KEVDIAAHEIRWLPNLTFDQRVAFIHKLRDDPSQSSELLSEAKKLNDSQ | SEQ ID NO:381 |
| PP13594 | KEIDEAKHEIRWLPNLTFDQRVAFIHKLLDDDPSQSSELLSEAKKLNDSQ | SEQ ID NO:382 |
| PP13596 | KELRQAGHEIRWLPNLTFDQRVAFIHKLRDDPSQSSELLSEAKKLNDSQ | SEQ ID NO:383 |
| PP13597 | KELQSAAHEIRWLPNLTFDQRVAFIHKLKDDPSQSSELLSEAKKLNDSQ | SEQ ID NO:384 |
| PP13598 | KELEKAAHEIRWLPNLTFDQRVAFIHKLRDDPSQSSELLSEAKKLNDSQ | SEQ ID NO:385 |
| PP13600 | KEAHEAAHEIRWLPNLTFDQRVAFIHKLRDDPSQSSELLSEAKKLNDSQ | SEQ ID NO:386 |
| PP13604 | KELQAASHEIRWLPNLTFDQRVAFIHKLNDDPSQSSELLSEAKKLNDSQ | SEQ ID NO:387 |
| PP13605 | KEIESAKHEIRWLPNLTFDQRVAFIHKLRDDPSQSSELLSEAKKLNDSQ | SEQ ID NO:388 |
| PP13609 | KEWKVAAHEIRWLPNLTFDQRVAFIHKLRDDPSQSSELLSEAKKLNDSQ | SEQ ID NO:389 |
| PP13611 | KEWKAAAHEIRWLPNLTFDQRVAFIHKLDDDPSQSSELLSEAKKLNDSQ | SEQ ID NO:390 |
| PP13612 | KEIDLAKHEIRWLPNLTFDQRVAFIHKLNDDPSQSSELLSEAKKLNDSQ | SEQ ID NO:391 |
| PP13613 | KELEAARHEIRWLPNLTFDQRVAFIHKLNDDPSQSSELLSEAKKLNDSQ | SEQ ID NO:392 |

Figure 10

| Designation | Sequence | SEQ ID NO: |
|---|---|---|
| PP13615 | KEAATAGHEIRWLPNLTFDQRVAFIHKLRDDPSQSSELLSEAKKLNDSQ | SEQ ID NO:393 |
| PP13616 | KEWQQAAHEIRWLPNLTFDQRVAFIHKLRDDPSQSSELLSEAKKLNDSQ | SEQ ID NO:394 |
| PP13617 | KEADQAGHEIRWLPNLTFDQRVAFIRKLRDDPSQSSELLSEAKKLNDSQ | SEQ ID NO:395 |
| PP13620 | KEQSKAAHEIRWLPNLTFDQRVAFIHKLRDDPSQSSELLSEAKKLNDSQ | SEQ ID NO:396 |
| PP13621 | KEADAAGHEIRWLPNLTFDQRVAFIHKLRDDPSQSSELLSEAKKLNDSQ | SEQ ID NO:397 |
| PP13622 | KEFMDAGHEIRWLPNLTFDQRVAFIHKLRDDPSQSSELLSEAKKLNDSQ | SEQ ID NO:398 |
| PP13624 | KESKQAAHEIRWLPNLTFDQRVAFIHKLRDDPSQSSELLSEAKKLNDSQ | SEQ ID NO:399 |
| PP13625 | KEVSDAAHEIRWLPNLTFDQRVAFIHKLRDDPSQSSELLSEAKKLNDSQ | SEQ ID NO:400 |
| PP13626 | KEADSASHEIRWLPNLTFDQRVAFIHKLRDDPSQSSELLSEAKKLNDSQ | SEQ ID NO:401 |
| PP13627 | KELMEAAHEIRWLPNLTFDQRVAFIHKLRDDPSQSSELLSEAKKLNDSQ | SEQ ID NO:402 |
| PP13628 | KELNTAAHEIRWLPNLTFDQRVAFIHKLKDDPSQSSELLSEAKKLNDSQ | SEQ ID NO:403 |
| PP13629 | KEVHEAGHEIRWLPNLTFDQRVAFIHKLRDDPSQSSELLSEAKKLNDSQ | SEQ ID NO:404 |
| PP13633 | KESTAAAHEIRWLPNLTFDQRVAFIHKLRDDPSQSSELLSEAKKLNDSQ | SEQ ID NO:405 |
| PP13634 | KEWYNAAHEIRWLPNLTFDQRVAFIHKLRDDPSQSSELLSEAKKLNDSQ | SEQ ID NO:406 |
| PP13635 | KEWNDAAHEIRWLPNLTFDQRVAFIHKLRDDPSQSSELLSEAKKLNDSQ | SEQ ID NO:407 |
| PP13637 | KEVEVAKHEIRWLPNLTFDQRVAFIHKLDDDPSQSSELLSEAKKLNDSQ | SEQ ID NO:408 |
| PP13638 | KEFNFAAHEIRWLPNLTFDQRVAFIHKLRDDPSQSSELLSEAKKLNDSQ | SEQ ID NO:409 |
| PP13639 | KEHDSAAHEIRWLPNLTFDQRVAFIHKLRDDPSQSSELLSEAKKLNDSQ | SEQ ID NO:410 |
| PP13640 | KEWMDAAHEIRWLPNLTFDQRVAFIHKLRDDPSQSSELLSEAKKLNDSQ | SEQ ID NO:411 |
| PP13641 | KEFSAAGHEIRWLPNLTFDQRVAFIHKLRDDPSQSSELLSEAKKLNDSQ | SEQ ID NO:412 |
| PP13644 | KELNSAAAHEIRWLPNLTFDQRVAFIHKLRDDPSQSSELLSEAKKLNDSQ | SEQ ID NO:413 |
| PP13645 | KEVDTAAHEIRWLPNLTFDQRVAFIHKLRDDPSQSSELLSEAKKLNDSQ | SEQ ID NO:414 |
| PP13648 | KESQIAGHEIRWLPNLTFDQRVAFIHKLRDDPSQSSELLSEAKKLNDSQ | SEQ ID NO:415 |
| PP13651 | KEVSAASHEIRWLPNLTFDQRVAFIHKLRDDPSQSSELLSEAKKLNDSQ | SEQ ID NO:416 |
| PP13652 | KEDQDAAHEIRWLPNLTFDQRVAFIHKLDDDPSQSSELLSEAKKLNDSQ | SEQ ID NO:417 |
| PP13654 | KELEAAKHEIRWLPNLTFDQRVAFIHKLRDDPSQSSELLSEAKKLNDSQ | SEQ ID NO:418 |
| PP13655 | KESKRAAHEIRWLPNLTFDQRVAFIHKLRDDPSQSSELLSEAKKLNDSQ | SEQ ID NO:419 |
| PP13656 | KEYVKAGHEIRWLPNLTFDQRVAFIRKLRDDPSQSSELLSEAKKLNDSQ | SEQ ID NO:420 |

Figure 1P

| Designation | Sequence | SEQ ID NO: |
|---|---|---|
| PP13657 | KEFSRAGHEIRWLPNLTFDQRVAFIHKLRDDPSQSSELLSEAKKLNDSQ | SEQ ID NO:421 |
| PP13659 | KEWQFAAHEIRWLPNLTFDQRVAFIHKLRDDPSQSSELLSEAKKLNDSQ | SEQ ID NO:422 |
| PP13663 | KEWQIAAHEIRWLPNLTFDQRVAFIHKLRDDPSQSSELLSEAKKLNDSQ | SEQ ID NO:423 |
| PP13664 | KELQEAAHEIRWLPNLTFDQRVAFIHKLRDDPSQSSELLSEAKKLNDSQ | SEQ ID NO:424 |
| PP13667 | KEYRAAAHEIRWLPNLTFDQRVAFIHKLRDDPSQSSELLSEAKKLNDSQ | SEQ ID NO:425 |
| PP13669 | KELASAGHEIRWLPNLTFDQRVAFIHKLRDDPSQSSELLSEAKKLNDSQ | SEQ ID NO:426 |
| PP13672 | KEVQSASHEIRWLPNLTFDQRVAFIHKLRDDPSQSSELLSEAKKLNDSQ | SEQ ID NO:427 |
| PP13674 | KEIEDAGHEIRWLPNLTFDQRVAFIHKLRDDPSQSSELLSEAKKLNDSQ | SEQ ID NO:428 |
| PP13675 | KENQAAAHEIRWLPNLTFDQRVAFIHKLRDDPSQSSELLSEAKKLNDSQ | SEQ ID NO:429 |
| PP13676 | KEATSAGHEIRWLPNLTFDQRVAFIVKLRDDPSQSSELLSEAKKLNDSQ | SEQ ID NO:430 |
| PP13678 | KEDEQAAHEIRWLPNLTFDQRVAFIHKLRDDPSQSSELLSEAKKLNDSQ | SEQ ID NO:431 |
| PP13684 | KEQNQAGHEIRWLPNLTFDQRVAFIHKLRDDPSQSSELLSEAKKLNDSQ | SEQ ID NO:432 |
| PP13688 | KEYTSAAHEIRWLPNLTFDQRVAFIHKLRDDPSQSSELLSEAKKLNDSQ | SEQ ID NO:433 |
| PP13691 | KEWDAAAHEIRWLPNLTFDQRVAFIHKLRDDPSQSSELLSEAKKLNDSQ | SEQ ID NO:434 |
| PP13692 | KEEMQAGHEIRWLPNLTFDQRVAFIHKLRDDPSQSSELLSEAKKLNDSQ | SEQ ID NO:435 |
| PP13694 | KELSDAAHEIRWLPNLTFDQRVAFIHKLNDDPSQSSELLSEAKKLNDSQ | SEQ ID NO:436 |
| PP13695 | KEIDAAKHEIRWLPNLTFDQRVAFIHKLDDDPSQSSELLSEAKKLNDSQ | SEQ ID NO:437 |
| PP13697 | KEAERAGHEIRWLPNLTFDQRVAFIRKLRDDPSQSSELLSEAKKLNDSQ | SEQ ID NO:438 |
| PP13706 | KEEDSAAHEIRWLPNLTFDQRVAFIHKLRDDPSQSSELLSEAKKLNDSQ | SEQ ID NO:439 |
| PP13708 | KEQKAAGHEIRWLPNLTFDQRVAFIHKLRDDPSQSSELLSEAKKLNDSQ | SEQ ID NO:440 |
| PP13710 | KEWDQAAHEIRWLPNLTFDQRVAFIHKLRDDPSQSSELLSEAKKLNDSQ | SEQ ID NO:441 |
| PP13711 | KEAKAAAHEIRWLPNLTFDQRVAFIHKLRDDPSQSSELLSEAKKLNDSQ | SEQ ID NO:442 |
| PP13714 | KELSEAAHEIRWLPNLTFDQRVAFIHKLRDDPSQSSELLSEAKKLNDSQ | SEQ ID NO:443 |
| PP13716 | KETEAAKHEIRWLPNLTFDQRVAFIHKLDDDPSQSSELLSEAKKLNDSQ | SEQ ID NO:444 |
| PP13719 | KEAKSAAHEIRWLPNLTFDQRVAFIHKLRDDPSQSSELLSEAKKLNDSQ | SEQ ID NO:445 |
| PP13720 | KEQSAAAHEIRWLPNLTFDQRVAFIHKLNDDPSQSSELLSEAKKLNDSQ | SEQ ID NO:446 |
| PP13721 | KEKERAAHEIRWLPNLTFDQRVAFIHKLRDDPSQSSELLSEAKKLNDSQ | SEQ ID NO:447 |
| PP13725 | KEWDEAAHEIRWLPNLTFDQRVAFIHKLKDDPSQSSELLSEAKKLNDSQ | SEQ ID NO:448 |

Figure 1Q

| Designation | Sequence | SEQ ID NO: |
|---|---|---|
| PP13727 | KEEKDAAHEIRWLPNLTFDQRVAFIHKLRDDPSQSSELLSEAKKLNDSQ | SEQ ID NO:449 |
| PP13728 | KEIENAAHEIRWLPNLTFDQRVAFIHKLRDDPSQSSELLSEAKKLNDSQ | SEQ ID NO:450 |
| PP13732 | KETKEAAHEIRWLPNLTFDQRVAFTWKLRDDPSQSSELLSEAKKLNDSQ | SEQ ID NO:451 |
| PP13735 | KELEAAKHEIRWLPNLTFDQRVAFIHKLWDDPSQSSELLSEAKKLNDSQ | SEQ ID NO:452 |
| PP13736 | KEWAEAAHEIRWLPNLTFDQRVAFIHKLNDDPSQSSELLSEAKKLNDSQ | SEQ ID NO:453 |
| PP13740 | KESQEAGHEIRWLPNLTFDQRVAFIHKLRDDPSQSSELLSEAKKLNDSQ | SEQ ID NO:454 |
| PP13742 | KELSTAAHEIRWLPNLTFDQRVAFIHKLRDDPSQSSELLSEAKKLNDSQ | SEQ ID NO:455 |
| PP13747 | KEIEEAGHEIRWLPNLTFDQRVAFIHKLRDDPSQSSELLSEAKKLNDSQ | SEQ ID NO:456 |
| PP13749 | KELQTASHEIRWLPNLTFDQRVAFIHKLRDDPSQSSELLSEAKKLNDSQ | SEQ ID NO:457 |
| PP13750 | KEQDSAAHEIRWLPNLTFDQRVAFIRKLRDDPSQSSELLSEAKKLNDSQ | SEQ ID NO:458 |
| PP13751 | KESASAGHEIRWLPNLTFDQRVAFIHKLRDDPSQSSELLSEAKKLNDSQ | SEQ ID NO:459 |
| PP13752 | KEVAKASHEIRWLPNLTFDQRVAFIHKLWDDPSQSSELLSEAKKLNDSQ | SEQ ID NO:460 |
| PP13758 | KEVQEAAHEIRWLPNLTFDQRVAFIHKLRDDPSQSSELLSEAKKLNDSQ | SEQ ID NO:461 |
| PP13759 | KESYEAAHEIRWLPNLTFDQRVAFIRKLRDDPSQSSELLSEAKKLNDSQ | SEQ ID NO:462 |
| PP13760 | KETAEAGHEIRWLPNLTFDQRVAFIHKLRDDPSQSSELLSEAKKLNDSQ | SEQ ID NO:463 |
| PP13761 | KELEEAAHEIRWLPNLTFDQRVAFIHKLRDDPSQSSELLSEAKKLNDSQ | SEQ ID NO:464 |
| PP13771 | KEAAAAGHEIRWLPNLTFDQRVAFIHKLRDDPSQSSELLSEAKKLNDSQ | SEQ ID NO:465 |
| PP13773 | KEYVDAGHEIRWLPNLTFDQRVAFIRKLRDDPSQSSELLSEAKKLNDSQ | SEQ ID NO:466 |
| PP13776 | KEIQEAGHEIRWLPNLTFDQRVAFIHKLRDDPSQSSELLSEAKKLNDSQ | SEQ ID NO:467 |
| PP13777 | KESATAAHEIRWLPNLTFDQRVAFIHKLRDDPSQSSELLSEAKKLNDSQ | SEQ ID NO:468 |
| PP13780 | KEWMSAAHEIRWLPNLTFDQRVAFIHKLRDDPSQSSELLSEAKKLNDSQ | SEQ ID NO:469 |
| PP13782 | KEREQASHEIRWLPNLTFDQRVAFIHKLRDDPSQSSELLSEAKKLNDSQ | SEQ ID NO:470 |
| PP13783 | KEIEQAGHEIRWLPNLTFDQRVAFIHKLRDDPSQSSELLSEAKKLNDSQ | SEQ ID NO:471 |
| PP13786 | KEHNAAAHEIRWLPNLTFDQRVAFIHKLRDDPSQSSELLSEAKKLNDSQ | SEQ ID NO:472 |
| PP13792 | KEIEVAAHEIRWLPNLTFDQRVAFIHKLRDDPSQSSELLSEAKKLNDSQ | SEQ ID NO:473 |
| PP13796 | KERAEAAHEIRWLPNLTFDQRVAFTWKLRDDPSQSSELLSEAKKLNDSQ | SEQ ID NO:474 |
| PP13799 | KESELAAHEIRWLPNLTFDQRVAFIHKLRDDPSQSSELLSEAKKLNDSQ | SEQ ID NO:475 |
| PP13806 | KEYRAAGHEIRWLPNLTFDQRVAFIHKLRDDPSQSSELLSEAKKLNDSQ | SEQ ID NO:476 |

Figure 1R

| Designation | Sequence | SEQ ID NO: |
|---|---|---|
| PP13808 | KETANAAHEIRWLPNLTFDQRVAFIHKLRDDPSQSSELLSEAKKLNDSQ | SEQ ID NO: 477 |
| PP13811 | KEWYEAAHEIRWLPNLTFDQRVAFIHKLRDDPSQSSELLSEAKKLNDSQ | SEQ ID NO: 478 |
| PP13812 | KEEQEAAHEIRWLPNLTFDQRVAFIHKLWDDPSQSSELLSEAKKLNDSQ | SEQ ID NO: 479 |
| PP13823 | KEHDDAAHEIRWLPNLTFDQRVAFIHKLRDDPSQSSELLSEAKKLNDSQ | SEQ ID NO: 480 |
| PP13824 | KEWYSAAHEIRWLPNLTFDQRVAFIHKLRDDPSQSSELLSEAKKLNDSQ | SEQ ID NO: 481 |
| PP13838 | KEISDAAHEIRWLPNLTFDQRVAFIHKLRDDPSQSSELLSEAKKLNDSQ | SEQ ID NO: 482 |
| PP13840 | KEYTAAHEIRWLPNLTFDQRVAFIHKLRDDPSQSSELLSEAKKLNDSQ | SEQ ID NO: 483 |
| PP13842 | KEISQAAHEIRWLPNLTFDQRVAFIHKLRDDPSQSSELLSEAKKLNDSQ | SEQ ID NO: 484 |
| PP13845 | KENDDAAHEIRWLPNLTFDQRVAFIHKLRDDPSQSSELLSEAKKLNDSQ | SEQ ID NO: 485 |
| PP13846 | KESEIAGHEIRWLPNLTFDQRVAFIRKLRDDPSQSSELLSEAKKLNDSQ | SEQ ID NO: 486 |
| PP13848 | KEQADAAHEIRWLPNLTFDQRVAFIHKLRDDPSQSSELLSEAKKLNDSQ | SEQ ID NO: 487 |
| PP13849 | KETESAAHEIRWLPNLTFDQRVAFIHKLDDDPSQSSELLSEAKKLNDSQ | SEQ ID NO: 488 |
| PP13860 | KEISDAKHEIRWLPNLTFDQRVAFIHKLDDDPSQSSELLSEAKKLNDSQ | SEQ ID NO: 489 |
| PP13865 | KEHLNAAHEIRWLPNLTFDQRVAFIHKLRDDPSQSSELLSEAKKLNDSQ | SEQ ID NO: 490 |
| PP13866 | KEWLDAAHEIRWLPNLTFDQRVAFIHKLRDDPSQSSELLSEAKKLNDSQ | SEQ ID NO: 491 |
| PP13875 | KENAAAAHEIRWLPNLTFDQRVAFIHKLRDDPSQSSELLSEAKKLNDSQ | SEQ ID NO: 492 |
| PP13879 | KEAELAGHEIRWLPNLTFDQRVAFIRKLRDDPSQSSELLSEAKKLNDSQ | SEQ ID NO: 493 |
| PP13480 | KEVTDAGHEIRWLPNLTFDQRVAFIEKLKDDPSQSSELLSEAKKLNDSQ | SEQ ID NO: 494 |
| PP13481 | KELDSASHEIRWLPNLTFDQRVAFINKLLDDPSQSSELLSEAKKLNDSQ | SEQ ID NO: 495 |
| PP13482 | KEINLAKHEIRWLPNLTFDQRVAFIEKLNDDPSQSSELLSEAKKLNDSQ | SEQ ID NO: 496 |
| PP13483 | KESEVAKHEIRWLPNLTFDQRVAFIHKLSDDPSQSSELLSEAKKLNDSQ | SEQ ID NO: 497 |
| PP13484 | KESAEAGHEIRWLPNLTFDQRVAFIHKLQDDPSQSSELLSEAKKLNDSQ | SEQ ID NO: 498 |
| PP13485 | KEYSNAAHEIRWLPNLTFDQRVAFIDKLSDDPSQSSELLSEAKKLNDSQ | SEQ ID NO: 499 |
| PP13487 | KETNNAGHEIRWLPNLTFDQRVAFIIKLRDDPSQSSELLSEAKKLNDSQ | SEQ ID NO: 500 |
| PP13488 | KEVEFAAHEIRWLPNLTFDQRVAFIHKLNDDPSQSSELLSEAKKLNDSQ | SEQ ID NO: 501 |
| PP13489 | KEVELAGHEIRWLPNLTFDQRVAFIEKLHDDPSQSSELLSEAKKLNDSQ | SEQ ID NO: 502 |
| PP13490 | KEVLKASHEIRWLPNLTFDQRVAFITKLQDDPSQSSELLSEAKKLNDSQ | SEQ ID NO: 503 |
| PP13491 | KEIANAGHEIRWLPNLTFDQRVAFIRKLDDDPSQSSELLSEAKKLNDSQ | SEQ ID NO: 504 |

Figure 1S

| Designation | Sequence | SEQ ID NO: |
|---|---|---|
| PP13493 | KEYMKAGHEIRWLPNLTFDQRVAFIVKLRDDPSQSSELLSEAKKLNDSQ | SEQ ID NO:505 |
| PP13495 | KEHANAQHEIRWLPNLTFDQRVAFIHKLQDDPSQSSELLSEAKKLNDSQ | SEQ ID NO:506 |
| PP13496 | KEVDIASHEIRWLPNLTYDQRVAFIWKLRDDPSQSSELLSEAKKLNDSQ | SEQ ID NO:507 |
| PP13497 | KEEVFAAHEIRWLPNLTYDQRVAFIVKLRDDPSQSSELLSEAKKLNDSQ | SEQ ID NO:508 |
| PP13499 | KEFNTAAHEIRWLPNLTFDQRVAFINKLDDDPSQSSELLSEAKKLNDSQ | SEQ ID NO:509 |
| PP13501 | KEVDVAGHEIRWLPNLTFDQRVAFIRKLNDDPSQSSELLSEAKKLNDSQ | SEQ ID NO:510 |
| PP13502 | KEWSLAAHEIRWLPNLTFDQRVAFIVKLRDDPSQSSELLSEAKKLNDSQ | SEQ ID NO:511 |
| PP13503 | KELDDAAHEIRWLPNLTFDQRVAFIQKLQDDPSQSSELLSEAKKLNDSQ | SEQ ID NO:512 |
| PP13505 | KERHEAGHEIRWLPNLTFDQRVAFIHKLNDDPSQSSELLSEAKKLNDSQ | SEQ ID NO:513 |
| PP13506 | KEISDAIHEIRWLPNLTFDQRVAFIHKLQDDPSQSSELLSEAKKLNDSQ | SEQ ID NO:514 |
| PP13507 | KEWETAGHEIRWLPNLTFDQRVAFIVKLSDDPSQSSELLSEAKKLNDSQ | SEQ ID NO:515 |
| PP13508 | KERYWASHEIRWLPNLTFDQRVAFIHKLNDDPSQSSELLSEAKKLNDSQ | SEQ ID NO:516 |
| PP13512 | KEIDWAGHEIRWLPNLTFDQRVAFIHKLLDDPSQSSELLSEAKKLNDSQ | SEQ ID NO:517 |
| PP13515 | KEQSKAGHEIRWLPNLTFDQRVAFIHKLRDDPSQSSELLSEAKKLNDSQ | SEQ ID NO:518 |
| PP13518 | KEIEAAQHEIRWLPNLTFDQRVAFINKLRDDPSQSSELLSEAKKLNDSQ | SEQ ID NO:519 |
| PP13519 | KEHEQAAHEIRWLPNLTFDQRVAFIRKLVDDPSQSSELLSEAKKLNDSQ | SEQ ID NO:520 |
| PP13520 | KEAEQAGHEIRWLPNLTFDQRVAFINKLQDDPSQSSELLSEAKKLNDSQ | SEQ ID NO:521 |
| PP13522 | KEVDYAAHEIRWLPNLTFDQRVAFIHKLWDDPSQSSELLSEAKKLNDSQ | SEQ ID NO:522 |
| PP13525 | KEYSAAGHEIRWLPNLTFDQRVAFIEKLRDDPSQSSELLSEAKKLNDSQ | SEQ ID NO:523 |
| PP13561 | KELATASHEIRWLPNLTFDQRVAFIHKLRDDPSQSSELLSEAKKLNDSQ | SEQ ID NO:524 |
| PP13572 | KEYRVAGHEIRWLPNLTFDQRVAFIQKLRDDPSQSSELLSEAKKLNDSQ | SEQ ID NO:525 |
| PP13575 | KEVVSAKHEIRWLPNLTFDQRVAFIHKLDDDPSQSSELLSEAKKLNDSQ | SEQ ID NO:526 |
| PP13576 | KESAQAAHEIRWLPNLTFDQRVAFIRKLRDDPSQSSELLSEAKKLNDSQ | SEQ ID NO:527 |
| PP13584 | KEYSAAGHEIRWLPNLTFDQRVAFIHKLRDDPSQSSELLSEAKKLNDSQ | SEQ ID NO:528 |
| PP13589 | KEQKEAAAEIRWLPNLTFDQRVAFIHKLRDDPSQSSELLSEAKKLNDSQ | SEQ ID NO:529 |
| PP13590 | KEAAIAGKEIRWLPNLTFDQRVAFIHKLRDDPSQSSELLSEAKKLNDSQ | SEQ ID NO:530 |
| PP13591 | KEISKAKHEIRWLPNLTFDQRVAFIHKLRDDPSQSSELLSEAKKLNDSQ | SEQ ID NO:531 |
| PP13593 | KESVAAAHEIRWLPNLTFDQRVAFIWKLRDDPSQSSELLSEAKKLNDSQ | SEQ ID NO:532 |

Figure 1T

| Designation | Sequence | SEQ ID NO: |
|---|---|---|
| PP13595 | KEIQQAKHEIRWLPNLTFDQRVAFIHKLDDDPSQSSELLSEAKKLNDSQ | SEQ ID NO:533 |
| PP13599 | KEITSAKHEIRWLPNLTFDQRVAFIHKLDDDPSQSSELLSEAKKLNDSQ | SEQ ID NO:534 |
| PP13601 | KEQDVAAHEIRWLPNLTFDQRVAFIRKLDDDPSQSSELLSEAKKLNDSQ | SEQ ID NO:535 |
| PP13603 | KELERAAHEIRWLPNLTFDQRVAFINKLKDDPSQSSELLSEAKKLNDSQ | SEQ ID NO:536 |
| PP13607 | KENQLAAHEIRWLPNLTFDQRVAFIHKLRDDPSQSSELLSEAKKLNDSQ | SEQ ID NO:537 |
| PP13608 | KEISQAKHEIRWLPNLTFDQRVAFIHKLLDDPSQSSELLSEAKKLNDSQ | SEQ ID NO:538 |
| PP13610 | KEIANASHEIRWLPNLTFDQRVAFIYKLRDDPSQSSELLSEAKKLNDSQ | SEQ ID NO:539 |
| PP13614 | KEWQAAAHEIRWLPNLTFDQRVAFIRKLRDDPSQSSELLSEAKKLNDSQ | SEQ ID NO:540 |
| PP13618 | KERKDAGHEIRWLPNLTFDQRVAFIRKLRDDPSQSSELLSEAKKLNDSQ | SEQ ID NO:541 |
| PP13619 | KEITQAKHEIRWLPNLTFDQRVAFIHKLDDDPSQSSELLSEAKKLNDSQ | SEQ ID NO:542 |
| PP13623 | KEFIQAGHEIRWLPNLTFDQRVAFIHKLRDDPSQSSELLSEAKKLNDSQ | SEQ ID NO:543 |
| PP13630 | KEWNTASHEIRWLPNLTFDQRVAFIHKLRDDPSQSSELLSEAKKLNDSQ | SEQ ID NO:544 |
| PP13631 | KEKFVAAHEIRWLPNLTFDQRVAFIHKLKDDPSQSSELLSEAKKLNDSQ | SEQ ID NO:545 |
| PP13632 | KEADSAGAEIRWLPNLTFDQRVAFIHKLRDDPSQSSELLSEAKKLNDSQ | SEQ ID NO:546 |
| PP13636 | KESSVAAAEIRWLPNLTFDQRVAFIHKLRDDPSQSSELLSEAKKLNDSQ | SEQ ID NO:547 |
| PP13642 | KEVDLAGREIRWLPNLTFDQRVAFIHKLRDDPSQSSELLSEAKKLNDSQ | SEQ ID NO:548 |
| PP13643 | KEQERAAAEIRWLPNLTFDQRVAFIHKLDDDPSQSSELLSEAKKLNDSQ | SEQ ID NO:549 |
| PP13646 | KEIWQAKHEIRWLPNLTFDQRVAFIHKLDDDPSQSSELLSEAKKLNDSQ | SEQ ID NO:550 |
| PP13647 | KELNQAKHEIRWLPNLTFDQRVAFIHKLEDDPSQSSELLSEAKKLNDSQ | SEQ ID NO:551 |
| PP13649 | KELQQASHEIRWLPNLTFDQRVAFIHKLRDDPSQSSELLSEAKKLNDSQ | SEQ ID NO:552 |
| PP13650 | KEINQAKHEIRWLPNLTFDQRVAFIHKLRDDPSQSSELLSEAKKLNDSQ | SEQ ID NO:553 |
| PP13653 | KELVLAGHEIRWLPNLTFDQRVAFIHKLRDDPSQSSELLSEAKKLNDSQ | SEQ ID NO:554 |
| PP13658 | KELTSAAHEIRWLPNLTFDQRVAFIHKLRDDPSQSSELLSEAKKLNDSQ | SEQ ID NO:555 |
| PP13661 | KEWNAAAREIRWLPNLTFDQRVAFIHKLRDDPSQSSELLSEAKKLNDSQ | SEQ ID NO:556 |
| PP13662 | KEILHAKHEIRWLPNLTFDQRVAFIHKLDDDPSQSSELLSEAKKLNDSQ | SEQ ID NO:557 |
| PP13665 | KEVLTAKHEIRWLPNLTFDQRVAFIHKLNDDPSQSSELLSEAKKLNDSQ | SEQ ID NO:558 |
| PP13666 | KENSKAAHEIRWLPNLTFDQRVAFIHKLADDPSQSSELLSEAKKLNDSQ | SEQ ID NO:559 |
| PP13668 | KEVMTAKHEIRWLPNLTFDQRVAFIHKLDDDPSQSSELLSEAKKLNDSQ | SEQ ID NO:560 |

Figure 1U

| Designation | Sequence | SEQ ID NO: |
|---|---|---|
| PP13671 | KEARDAAHEIRWLPNLTFDQRVAFIHKLSDDPSQSSELLSEAKKLNDSQ | SEQ ID NO:561 |
| PP13673 | KERSKAAHEIRWLPNLTFDQRVAFIHKLKDDPSQSSELLSEAKKLNDSQ | SEQ ID NO:562 |
| PP13677 | KEIYSAKHEIRWLPNLTFDQRVAFIHKLDDDPSQSSELLSEAKKLNDSQ | SEQ ID NO:563 |
| PP13679 | KEVQSAKHEIRWLPNLTFDQRVAFIHKLDDDPSQSSELLSEAKKLNDSQ | SEQ ID NO:564 |
| PP13680 | KETLEAAHEIRWLPNLTFDQRVAFIHKLKDDPSQSSELLSEAKKLNDSQ | SEQ ID NO:565 |
| PP13681 | KEQMRAAHEIRWLPNLTFDQRVAFIRKLRDDPSQSSELLSEAKKLNDSQ | SEQ ID NO:566 |
| PP13685 | KENKNAAHEIRWLPNLTFDQRVAFIHKLRDDPSQSSELLSEAKKLNDSQ | SEQ ID NO:567 |
| PP13687 | KETESAKHEIRWLPNLTFDQRVAFIHKLTDDPSQSSELLSEAKKLNDSQ | SEQ ID NO:568 |
| PP13689 | KETVQAKHEIRWLPNLTFDQRVAFIHKLDDDPSQSSELLSEAKKLNDSQ | SEQ ID NO:569 |
| PP13693 | KETASAKHEIRWLPNLTFDQRVAFIHKLDDDPSQSSELLSEAKKLNDSQ | SEQ ID NO:570 |
| PP13698 | KEVMDAKHEIRWLPNLTFDQRVAFIHKLDDDPSQSSELLSEAKKLNDSQ | SEQ ID NO:571 |
| PP13699 | KETDAAKHEIRWLPNLTFDQRVAFIHKLRDDPSQSSELLSEAKKLNDSQ | SEQ ID NO:572 |
| PP13701 | KELQIAKHEIRWLPNLTFDQRVAFIHKLDDDPSQSSELLSEAKKLNDSQ | SEQ ID NO:573 |
| PP13702 | KEWKDAAQEIRWLPNLTFDQRVAFIHKLRDDPSQSSELLSEAKKLNDSQ | SEQ ID NO:574 |
| PP13703 | KERDSAAHEIRWLPNLTFDQRVAFIRKLRDDPSQSSELLSEAKKLNDSQ | SEQ ID NO:575 |
| PP13704 | KEIAAAKHEIRWLPNLTFDQRVAFIRKLRDDPSQSSELLSEAKKLNDSQ | SEQ ID NO:576 |
| PP13707 | KESVKAKHEIRWLPNLTFDQRVAFIHKLDDDPSQSSELLSEAKKLNDSQ | SEQ ID NO:577 |
| PP13709 | KENERAKHEIRWLPNLTFDQRVAFIHKLRDDPSQSSELLSEAKKLNDSQ | SEQ ID NO:578 |
| PP13712 | KEYKRAGHEIRWLPNLTFDQRVAFIHKLRDDPSQSSELLSEAKKLNDSQ | SEQ ID NO:579 |
| PP13713 | KEVRAASHEIRWLPNLTFDQRVAFIHKLRDDPSQSSELLSEAKKLNDSQ | SEQ ID NO:580 |
| PP13717 | KEDKRAAHEIRWLPNLTFDQRVAFIRKLRDDPSQSSELLSEAKKLNDSQ | SEQ ID NO:581 |
| PP13718 | KESEKAGKEIRWLPNLTFDQRVAFIRKLRDDPSQSSELLSEAKKLNDSQ | SEQ ID NO:582 |
| PP13722 | KEINRAKHEIRWLPNLTFDQRVAFIHKLDDDPSQSSELLSEAKKLNDSQ | SEQ ID NO:583 |
| PP13724 | KETQQASHEIRWLPNLTFDQRVAFIHKLRDDPSQSSELLSEAKKLNDSQ | SEQ ID NO:584 |
| PP13729 | KENQSAAHEIRWLPNLTFDQRVAFIRKLRDDPSQSSELLSEAKKLNDSQ | SEQ ID NO:585 |
| PP13730 | KEAKQASHEIRWLPNLTFDQRVAFIVKLRDDPSQSSELLSEAKKLNDSQ | SEQ ID NO:586 |
| PP13731 | KEAAQAAHEIRWLPNLTFDQRVAFIHKLRDDPSQSSELLSEAKKLNDSQ | SEQ ID NO:587 |
| PP13733 | KEVQYASHEIRWLPNLTFDQRVAFIHKLRDDPSQSSELLSEAKKLNDSQ | SEQ ID NO:588 |

Figure 1V

| Designation | Sequence | SEQ ID NO: |
|---|---|---|
| PP13734 | KELRNAAHEIRWLPNLTFDQRVAFIHKLRDDPSQSSELLSEAKKLNDSQ | SEQ ID NO:589 |
| PP13737 | KEQRAAAHEIRWLPNLTFDQRVAFIHKLRDDPSQSSELLSEAKKLNDSQ | SEQ ID NO:590 |
| PP13739 | KEASEAAAEIRWLPNLTFDQRVAFIHKLRDDPSQSSELLSEAKKLNDSQ | SEQ ID NO:591 |
| PP13741 | KESVIAAHEIRWLPNLTFDQRVAFIHKLRDDPSQSSELLSEAKKLNDSQ | SEQ ID NO:592 |
| PP13744 | KEILRAKHEIRWLPNLTFDQRVAFIHKLDDDPSQSSELLSEAKKLNDSQ | SEQ ID NO:593 |
| PP13746 | KESKTAAHEIRWLPNLTFDQRVAFIQKLRDDPSQSSELLSEAKKLNDSQ | SEQ ID NO:594 |
| PP13748 | KELAEASHEIRWLPNLTFDQRVAFIHKLFDDPSQSSELLSEAKKLNDSQ | SEQ ID NO:595 |
| PP13753 | KEATTAKHEIRWLPNLTFDQRVAFIHKLDDDPSQSSELLSEAKKLNDSQ | SEQ ID NO:596 |
| PP13754 | KEIENAAHEIRWLPNLTFDQRVAFIHKLRDDPSQSSELLSEAKKLNDSQ | SEQ ID NO:597 |
| PP13755 | KEAKDAAAEIRWLPNLTFDQRVAFIRKLRDDPSQSSELLSEAKKLNDSQ | SEQ ID NO:598 |
| PP13757 | KERLEAAAEIRWLPNLTFDQRVAFIHKLRDDPSQSSELLSEAKKLNDSQ | SEQ ID NO:599 |
| PP13762 | KEQMEAAAEIRWLPNLTFDQRVAFIHKLRDDPSQSSELLSEAKKLNDSQ | SEQ ID NO:600 |
| PP13763 | KEVKTASHEIRWLPNLTFDQRVAFIRKLRDDPSQSSELLSEAKKLNDSQ | SEQ ID NO:601 |
| PP13764 | KESFEASHEIRWLPNLTFDQRVAFIQKLRDDPSQSSELLSEAKKLNDSQ | SEQ ID NO:602 |
| PP13765 | KEIKSAKHEIRWLPNLTFDQRVAFIHKLDDDPSQSSELLSEAKKLNDSQ | SEQ ID NO:603 |
| PP13766 | KEIKNAKHEIRWLPNLTFDQRVAFIHKLDDDPSQSSELLSEAKKLNDSQ | SEQ ID NO:604 |
| PP13768 | KELQEAKHEIRWLPNLTFDQRVAFIHKLRDDPSQSSELLSEAKKLNDSQ | SEQ ID NO:605 |
| PP13769 | KERQNAAHEIRWLPNLTFDQRVAFIRKLRDDPSQSSELLSEAKKLNDSQ | SEQ ID NO:606 |
| PP13770 | KEVLQAKHEIRWLPNLTFDQRVAFIHKLDDDPSQSSELLSEAKKLNDSQ | SEQ ID NO:607 |
| PP13772 | KEANVASHEIRWLPNLTFDQRVAFIHKLDDDPSQSSELLSEAKKLNDSQ | SEQ ID NO:608 |
| PP13774 | KELDAAKHEIRWLPNLTFDQRVAFIHKLDDDPSQSSELLSEAKKLNDSQ | SEQ ID NO:609 |
| PP13775 | KETASAAHEIRWLPNLTFDQRVAFIHKLRDDPSQSSELLSEAKKLNDSQ | SEQ ID NO:610 |
| PP13778 | KEWKQAASEIRWLPNLTFDQRVAFIHKLRDDPSQSSELLSEAKKLNDSQ | SEQ ID NO:611 |
| PP13779 | KETASASHEIRWLPNLTFDQRVAFIHKLQDDPSQSSELLSEAKKLNDSQ | SEQ ID NO:612 |
| PP13781 | KESIVAGHEIRWLPNLTFDQRVAFIHKLRDDPSQSSELLSEAKKLNDSQ | SEQ ID NO:613 |
| PP13784 | KEIKQAKHEIRWLPNLTFDQRVAFIHKLDDDPSQSSELLSEAKKLNDSQ | SEQ ID NO:614 |
| PP13785 | KEQATASHEIRWLPNLTFDQRVAFIRKLRDDPSQSSELLSEAKKLNDSQ | SEQ ID NO:615 |
| PP13787 | KELNAAKHEIRWLPNLTFDQRVAFIHKLDDDPSQSSELLSEAKKLNDSQ | SEQ ID NO:616 |

Figure 1X

| Designation | Sequence | SEQ ID NO: |
|---|---|---|
| PP13788 | KEVKRAGHEIRWLPNLTFDQRVAFIRKLRDDPSQSSELLSEAKKLNDSQ | SEQ ID NO:617 |
| PP13789 | KESRNAAHEIRWLPNLTFDQRVAFIHKLQDDPSQSSELLSEAKKLNDSQ | SEQ ID NO:618 |
| PP13791 | KESITASAEIRWLPNLTFDQRVAFIRKLRDDPSQSSELLSEAKKLNDSQ | SEQ ID NO:619 |
| PP13793 | KEAATAAHEIRWLPNLTFDQRVAFIHKLQDDPSQSSELLSEAKKLNDSQ | SEQ ID NO:620 |
| PP13794 | KEVYAAKHEIRWLPNLTFDQRVAFIHKLDDDPSQSSELLSEAKKLNDSQ | SEQ ID NO:621 |
| PP13795 | KEISRAKHEIRWLPNLTFDQRVAFIHKLDDDPSQSSELLSEAKKLNDSQ | SEQ ID NO:622 |
| PP13798 | KEYVTAAHEIRWLPNLTFDQRVAFIHKLRDDPSQSSELLSEAKKLNDSQ | SEQ ID NO:623 |
| PP13800 | KEHIDAGHEIRWLPNLTFDQRVAFIHKLRDDPSQSSELLSEAKKLNDSQ | SEQ ID NO:624 |
| PP13801 | KEILQAKHEIRWLPNLTFDQRVAFIHKLNDDPSQSSELLSEAKKLNDSQ | SEQ ID NO:625 |
| PP13802 | KENSQAKHEIRWLPNLTFDQRVAFIHKLNDDPSQSSELLSEAKKLNDSQ | SEQ ID NO:626 |
| PP13803 | KEYRVAAKEIRWLPNLTFDQRVAFIHKLRDDPSQSSELLSEAKKLNDSQ | SEQ ID NO:627 |
| PP13804 | KEIYNAGHEIRWLPNLTFDQRVAFIRKLRDDPSQSSELLSEAKKLNDSQ | SEQ ID NO:628 |
| PP13805 | KESNEAAAEIRWLPNLTFDQRVAFIHKLRDDPSQSSELLSEAKKLNDSQ | SEQ ID NO:629 |
| PP13809 | KESQLAAAEIRWLPNLTFDQRVAFIRKLRDDPSQSSELLSEAKKLNDSQ | SEQ ID NO:630 |
| PP13810 | KELKEAGHEIRWLPNLTFDQRVAFIHKLQDDPSQSSELLSEAKKLNDSQ | SEQ ID NO:631 |
| PP13813 | KETRVASVEIRWLPNLTFDQRVAFIQKLNDDPSQSSELLSEAKKLNDSQ | SEQ ID NO:632 |
| PP13818 | KELRTAAHEIRWLPNLTFDQRVAFISKIWDDPSQSSELLSEAKKLNDSQ | SEQ ID NO:633 |
| PP13820 | KEKTYAHFEIRWLPNLTFDQRVAFIHKLRDDPSQSSELLSEAKKLNDSQ | SEQ ID NO:634 |
| PP13821 | KEEAQASHEIRWLPNLTFDQRVAFIHKLRDDPSQSSELLSEAKKLNDSQ | SEQ ID NO:635 |
| PP13822 | KEITSAAHEIRWLPNLTFDQRVAFIHKLRDDPSQSSELLSEAKKLNDSQ | SEQ ID NO:636 |
| PP13825 | KEVKTASHEIRWLPNLTFDQRVAFIHKLLDDPSQSSELLSEAKKLNDSQ | SEQ ID NO:637 |
| PP13826 | KETKVAAHEIRWLPNLTFDQRVAFIHKLRDDPSQSSELLSEAKKLNDSQ | SEQ ID NO:638 |
| PP13829 | KEDLVAQHEIRWLPNLTFDQRVAFIRKLRDDPSQSSELLSEAKKLNDSQ | SEQ ID NO:639 |
| PP13830 | KETQTAFNEIRWLPNLTYDQRAAFILKLWDDPSQSSELLSEAKKLNDSQ | SEQ ID NO:640 |
| PP13831 | KEIKDAGHEIRWLPNLTFDQRVAFIVKLRDDPSQSSELLSEAKKLNDSQ | SEQ ID NO:641 |
| PP13836 | KEYKEAGHEIRWLPNLTYDQRVAFIHKLKDDPSQSSELLSEAKKLNDSQ | SEQ ID NO:642 |
| PP13839 | KEAALAAHEIRWLPNLTFDQRVAFIHKLRDDPSQSSELLSEAKKLNDSQ | SEQ ID NO:643 |
| PP13843 | KEQERAAHEIRWLPNLTFDQRVAFIRKLRDDPSQSSELLSEAKKLNDSQ | SEQ ID NO:644 |

Figure 1Y

| Designation | Sequence | SEQ ID NO: |
|---|---|---|
| PP13844 | KEWFDAAHEIRWLPNLTFDQRVAFIRKLRDDPSQSSELLSEAKKLNDSQ | SEQ ID NO:645 |
| PP13847 | KEIIQAKHEIRWLPNLTFDQRVAFIHKLDDDPSQSSELLSEAKKLNDSQ | SEQ ID NO:646 |
| PP13850 | KELTNAKHEIRWLPNLTFDQRVAFIHKLDDDPSQSSELLSEAKKLNDSQ | SEQ ID NO:647 |
| PP13851 | KEIQLAKHEIRWLPNLTFDQRVAFIHKLDDDPSQSSELLSEAKKLNDSQ | SEQ ID NO:648 |
| PP13854 | KEIHDAKHEIRWLPNLTFDQRVAFIHKLQDDPSQSSELLSEAKKLNDSQ | SEQ ID NO:649 |
| PP13869 | KEVKIASHEIRWLPNLTFDQRVAFIHKLRDDPSQSSELLSEAKKLNDSQ | SEQ ID NO:650 |
| PP13870 | KEQHSAAHEIRWLPNLTFDQRVAFIRKLRDDPSQSSELLSEAKKLNDSQ | SEQ ID NO:651 |
| PP13872 | KEVFAASAEIRWLPNLTFDQRVAFIHKLRDDPSQSSELLSEAKKLNDSQ | SEQ ID NO:652 |
| PP13874 | KETDLAGHEIRWLPNLTFDQRVAFIRKLRDDPSQSSELLSEAKKLNDSQ | SEQ ID NO:653 |
| PP13877 | KEANFAGHEIRWLPNLTFDQRVAFIRKLRDDPSQSSELLSEAKKLNDSQ | SEQ ID NO:654 |
| PP13878 | KEFETAGHEIRWLPNLTFDQRVAFTTKLWDDPSQSSELLSEAKKLNDSQ | SEQ ID NO:655 |
| PP13880 | KEVNLAKHEIRWLPNLTFDQRVAFIHKLDDDPSQSSELLSEAKKLNDSQ | SEQ ID NO:656 |
| PP13881 | KEADTAAHEIRWLPNLTFDQRVAFIYKLRDDPSQSSELLSEAKKLNDSQ | SEQ ID NO:657 |
| PP13882 | KEFVDAGHEIRWLPNLTFDQRVAFIQKLRDDPSQSSELLSEAKKLNDSQ | SEQ ID NO:658 |
| PP13883 | KEDHKAEHEIRWLPNLTFDQRVAFIHKLRDDPSQSSELLSEAKKLNDSQ | SEQ ID NO:659 |
| PP13884 | KETVDAGHEIRWLPNLTFDQRVAFIHKLADDPSQSSELLSEAKKLNDSQ | SEQ ID NO:660 |
| PP13885 | KESQRAGHEIRWLPNLTFDQRVAFITKLRDDPSQSSELLSEAKKLNDSQ | SEQ ID NO:661 |
| PP13886 | KEWSSAAHEIRWLPNLTFDQRVAFIHKLQDDPSQSSELLSEAKKLNDSQ | SEQ ID NO:662 |
| PP13887 | KEVAVAGHEIRWLPNLTYDQRVAFIVKLRDDPSQSSELLSEAKKLNDSQ | SEQ ID NO:663 |
| PP13888 | KESAEAGHEIRWLPNLTFDQRVAFIEKLRDDPSQSSELLSEAKKLNDSQ | SEQ ID NO:664 |
| PP13889 | KEAVAAGHEIRWLPNLTFDQRVAFIHKLDDDPSQSSELLSEAKKLNDSQ | SEQ ID NO:665 |
| PP13890 | KEFQIAGHEIRWLPNLTFDQRVAFINKLDDDPSQSSELLSEAKKLNDSQ | SEQ ID NO:666 |
| PP13891 | KELMVAKHEIRWLPNLTFDQRVAFIHKLDDDPSQSSELLSEAKKLNDSQ | SEQ ID NO:667 |
| PP13892 | KEYDSAAHEIRWLPNLTYDQRVAFILKLRDDPSQSSELLSEAKKLNDSQ | SEQ ID NO:668 |
| PP13893 | KEVLEAKHEIRWLPNLTFDQRVAFIHKLDDDPSQSSELLSEAKKLNDSQ | SEQ ID NO:669 |
| PP13894 | KESIAASHEIRWLPNLTFDQRVAFIHKLRDDPSQSSELLSEAKKLNDSQ | SEQ ID NO:670 |
| PP13895 | KEVAEAGHEIRWLPNLTFDQRVAFISKLRDDPSQSSELLSEAKKLNDSQ | SEQ ID NO:671 |
| PP13896 | KEQAKAAHEIRWLPNLTFDQRVAFIHKLNDDPSQSSELLSEAKKLNDSQ | SEQ ID NO:672 |

Figure 1Z

| Designation | Sequence | SEQ ID NO: |
|---|---|---|
| PP13897 | KERDDAAHEIRWLPNLTFDQRVAFIEKLRDDPSQSSELLSEAKKLNDSQ | SEQ ID NO:673 |
| PP13898 | KEAKDASHEIRWLPNLTFDQRVAFIHKLRDDPSQSSELLSEAKKLNDSQ | SEQ ID NO:674 |
| PP13899 | KEASSAAHEIRWLPNLTFDQRVAFIQKLRDDPSQSSELLSEAKKLNDSQ | SEQ ID NO:675 |
| PP13900 | KEWMEASHEIRWLPNLTYDQRVAFIVKLRDDPSQSSELLSEAKKLNDSQ | SEQ ID NO:676 |
| PP13901 | KEQKNAAHEIRWLPNLTFDQRVAFIEKLRDDPSQSSELLSEAKKLNDSQ | SEQ ID NO:677 |
| PP13902 | KEIENAKHEIRWLPNLTFDQRVAFIHKLDDDPSQSSELLSEAKKLNDSQ | SEQ ID NO:678 |
| PP13903 | KEVNRASHEIRWLPNLTFDQRVAFIHKLLDDPSQSSELLSEAKKLNDSQ | SEQ ID NO:679 |
| PP13904 | KERLLAGHEIRWLPNLTFDQRVAFINKLRDDPSQSSELLSEAKKLNDSQ | SEQ ID NO:680 |
| PP13906 | KEVSIAGHEIRWLPNLTFDQRVAFIRKLRDDPSQSSELLSEAKKLNDSQ | SEQ ID NO:681 |
| PP13907 | KEKEVAAHEIRWLPNLTFDQRVAFIHKLDDDPSQSSELLSEAKKLNDSQ | SEQ ID NO:682 |
| PP13908 | KESERASHEIRWLPNLTFDQRVAFIHKLRDDPSQSSELLSEAKKLNDSQ | SEQ ID NO:683 |
| PP13909 | KEWNEAAHEIRWLPNLTFDQRVAFIHKLRDDPSQSSELLSEAKKLNDSQ | SEQ ID NO:684 |
| PP13910 | KENVDAAHEIRWLPNLTFDQRVAFIHKLRDDPSQSSELLSEAKKLNDSQ | SEQ ID NO:685 |
| PP13911 | KEADAASHEIRWLPNLTFDQRVAFIRKLRDDPSQSSELLSEAKKLNDSQ | SEQ ID NO:686 |
| PP13912 | KELESASHEIRWLPNLTFDQRVAFIHKLIDDPSQSSELLSEAKKLNDSQ | SEQ ID NO:687 |
| PP13913 | KEEQLAAHEIRWLPNLTFDQRVAFIHKLRDDPSQSSELLSEAKKLNDSQ | SEQ ID NO:688 |
| PP13914 | KEFELAGHEIRWLPNLTFDQRVAFIHKLDDDPSQSSELLSEAKKLNDSQ | SEQ ID NO:689 |
| PP13915 | KEAFVAQHEIRWLPNLTYDQRVAFIVKLRDDPSQSSELLSEAKKLNDSQ | SEQ ID NO:690 |
| PP13916 | KEALKASHEIRWLPNLTFDQRVAFINKLRDDPSQSSELLSEAKKLNDSQ | SEQ ID NO:691 |
| PP13917 | KELERAGHEIRWLPNLTFDQRVAFIKKLTDDPSQSSELLSEAKKLNDSQ | SEQ ID NO:692 |
| PP13918 | KEVEWAKHEIRWLPNLTFDQRVAFIHKLQDDPSQSSELLSEAKKLNDSQ | SEQ ID NO:693 |
| PP13919 | KEKASAQHEIRWLPNLTFDQRVAFIHKLDDDPSQSSELLSEAKKLNDSQ | SEQ ID NO:694 |
| PP13920 | KETEIAKHEIRWLPNLTFDQRVAFIHKLDDDPSQSSELLSEAKKLNDSQ | SEQ ID NO:695 |
| PP13921 | KEVNLAAHEIRWLPNLTFDQRVAFIHKLTDDPSQSSELLSEAKKLNDSQ | SEQ ID NO:696 |
| PP13922 | KEAEEAAHEIRWLPNLTFDQRVAFIHKLRDDPSQSSELLSEAKKLNDSQ | SEQ ID NO:697 |
| PP13923 | KETDRAKHEIRWLPNLTFDQRVAFIHKINDDPSQSSELLSEAKKLNDSQ | SEQ ID NO:698 |
| PP13925 | KEFAQAGHEIRWLPNLTFDQRVAFIHKLKDDPSQSSELLSEAKKLNDSQ | SEQ ID NO:699 |
| PP13926 | KETDEASHEIRWLPNLTFDQRVAFIRKLRDDPSQSSELLSEAKKLNDSQ | SEQ ID NO:700 |

Figure 1AA

| Designation | Sequence | SEQ ID NO: |
|---|---|---|
| PP13927 | KENADAGHEIRWLPNLTFDQRVAFIQKLRDDPSQSSELLSEAKKLNDSQ | SEQ ID NO:701 |
| PP13928 | KESTQAAHEIRWLPNLTFDQRVAFIHKLQDDPSQSSELLSEAKKLNDSQ | SEQ ID NO:702 |
| PP13929 | KEQALAAHEIRWLPNLTFDQRVAFIHKLNDDPSQSSELLSEAKKLNDSQ | SEQ ID NO:703 |
| PP13930 | KEAHAASHEIRWLPNLTFDQRVAFIHKLDDDPSQSSELLSEAKKLNDSQ | SEQ ID NO:704 |
| PP13932 | KEVDNAGHEIRWLPNLTFDQRVAFIQKLRDDPSQSSELLSEAKKLNDSQ | SEQ ID NO:705 |
| PP13993 | KEAGRAAHEIRWLPNLTWDQRVAFIWKLRDDPSQSSELLSEAKKLNDSQ | SEQ ID NO:706 |
| Z07918 | VDAKYAKEQDAAAHEIRWLPNLTFDQRVAFIHKLADDPSQSSELLSEAKKLNDSQAPK | SEQ ID NO:707 |
| Z10193 | VDAKYAKEWMRAAHEIRWLPNLTFDQRVAFIHKLEDDPSQSSELLSEAKKLNDSQAPK | SEQ ID NO:708 |
| Z10109 | VDAKYAKEANTAAHEIRWLPNLTFDQRVAFIRKLWDDPSQSSELLSEAKKLNDSQAPK | SEQ ID NO:709 |
| Z07960 | VDAKYAKEFESAAHEIRWLPNLTFDQRVAFIHKLSDDPSQSSELLSEAKKLNDSQAPK | SEQ ID NO:710 |
| Z10140 | VDAKYAKERSAAAHEIRWLPNLTFDQRVAFTLKLTDDPSQSSELLSEAKKLNDSQAPK | SEQ ID NO:711 |
| Z07930 | VDAKYAKESDSAVHEIRWLPNLTFDQRVAFIHKLLDDPSQSSELLSEAKKLNDSQAPK | SEQ ID NO:712 |
| Z10183 | VDAKYAKEADNAGHEIRWLPNLTWAQRWAFIHKLLDDPSQSSELLSEAKKLNDSQAPK | SEQ ID NO:713 |
| Z10111 | VDAKYAKEDTAAHEIRWLPNLTYEQRWAFIHKLYDDPSQSSELLSEAKKLNDSQAPK | SEQ ID NO:714 |
| Z10129 | VDAKYAKEQHDAAHEIRWLPNLTYDQRVAFIRKLHDDPSQSSELLSEAKKLNDSQAPK | SEQ ID NO:715 |
| Z10141 | VDAKYAKENQGAAHEIRWLPNLTWDQRVAFIRKLQDDPSQSSELLSEAKKLNDSQAPK | SEQ ID NO:716 |
| Z10156 | VDAKYAKERTQASHEIRWLPNLTYDQRVAFINKLRDDPSQSSELLSEAKKLNDSQAPK | SEQ ID NO:717 |
| Z10127 | VDAKYAKERKDAGHEIRWLPNLTFDQRSAFIKKLEDDPSQSSELLSEAKKLNDSQAPK | SEQ ID NO:718 |
| Z07909 | VDAKYAKERQEAAAHEIRWLPNLTFDQRVAFIVKLLDDPSQSSELLSEAKKLNDSQAPK | SEQ ID NO:719 |
| Z10152 | VDAKYAKEEDVAAHEIRWLPNLTFNQRAAFIDKLLDDPSQSSELLSEAKKLNDSQAPK | SEQ ID NO:720 |
| Z10145 | VDAKYAKENQDAAHEIRWLPNLTYDQRVAFIGKLNDDPSQSSELLSEAKKLNDSQAPK | SEQ ID NO:721 |
| Z10161 | VDAKYAKESGYAVHEIRWLPNLTFDQRVAFINKLQDDPSQSSELLSEAKKLNDSQAPK | SEQ ID NO:722 |
| Z13573 | VDAKYAKESKDAAHEIRWLPNLTFDQRVAFIHKLRDDPSQSSELLSEAKKLNDSQAPK | SEQ ID NO:723 |
| Z13574 | VDAKYAKEKEAAHEIRWLPNLTFDQRVAFIHKLRDDPSQSSELLSEAKKLNDSQAPK | SEQ ID NO:724 |
| Z13577 | VDAKYAKEWHQAAHEIRWLPNLTFDQRVAFIHKLRDDPSQSSELLSEAKKLNDSQAPK | SEQ ID NO:725 |
| Z13578 | VDAKYAKEWTDAAHEIRWLPNLTFDQRVAFIHKLRDDPSQSSELLSEAKKLNDSQAPK | SEQ ID NO:726 |
| Z13579 | VDAKYAKEISAASHEIRWLPNLTFDQRVAFIHKLRDDPSQSSELLSEAKKLNDSQAPK | SEQ ID NO:727 |
| Z13581 | VDAKYAKEQQAAAHEIRWLPNLTFDQRVAFIHKLRDDPSQSSELLSEAKKLNDSQAPK | SEQ ID NO:728 |

Figure 1BB

| Designation | Sequence | SEQ ID NO: |
|---|---|---|
| Z13583 | VDAKYAKELEKAGHEIRWLPNLTFDQRVAFIHKLRDDPSQSSELLSEAKKLNDSQAPK | SEQ ID NO:729 |
| Z13585 | VDAKYAKEYLDAAHEIRWLPNLTFDQRVAFIHKLRDDPSQSSELLSEAKKLNDSQAPK | SEQ ID NO:730 |
| Z13586 | VDAKYAKELKDAGHEIRWLPNLTFDQRVAFIHKLRDDPSQSSELLSEAKKLNDSQAPK | SEQ ID NO:731 |
| Z13587 | VDAKYAKEHVDAAHEIRWLPNLTFDQRVAFIHKLRDDPSQSSELLSEAKKLNDSQAPK | SEQ ID NO:732 |
| Z13588 | VDAKYAKEYAAAAHEIRWLPNLTFDQRVAFIHKLRDDPSQSSELLSEAKKLNDSQAPK | SEQ ID NO:733 |
| Z13592 | VDAKYAKEVDIAAHEIRWLPNLTFDQRVAFIHKLRDDPSQSSELLSEAKKLNDSQAPK | SEQ ID NO:734 |
| Z13594 | VDAKYAKEIDEAKHEIRWLPNLTFDQRVAFIHKLDDDPSQSSELLSEAKKLNDSQAPK | SEQ ID NO:735 |
| Z13596 | VDAKYAKELRQAGHEIRWLPNLTFDQRVAFIHKLRDDPSQSSELLSEAKKLNDSQAPK | SEQ ID NO:736 |
| Z13597 | VDAKYAKELQSAAHEIRWLPNLTFDQRVAFIHKLKDDPSQSSELLSEAKKLNDSQAPK | SEQ ID NO:737 |
| Z13598 | VDAKYAKELEKAAHEIRWLPNLTFDQRVAFIHKLRDDPSQSSELLSEAKKLNDSQAPK | SEQ ID NO:738 |
| Z13600 | VDAKYAKEAHEAAHEIRWLPNLTFDQRVAFIHKLRDDPSQSSELLSEAKKLNDSQAPK | SEQ ID NO:739 |
| Z13604 | VDAKYAKELQAASHEIRWLPNLTFDQRVAFIHKLRDDPSQSSELLSEAKKLNDSQAPK | SEQ ID NO:740 |
| Z13605 | VDAKYAKEIESAKHEIRWLPNLTFDQRVAFIHKLRDDPSQSSELLSEAKKLNDSQAPK | SEQ ID NO:741 |
| Z13609 | VDAKYAKEWKVAAHEIRWLPNLTFDQRVAFIHKLNDDPSQSSELLSEAKKLNDSQAPK | SEQ ID NO:742 |
| Z13611 | VDAKYAKEWKAAAHEIRWLPNLTFDQRVAFIHKLRDDPSQSSELLSEAKKLNDSQAPK | SEQ ID NO:743 |
| Z13612 | VDAKYAKEIDLAKHEIRWLPNLTFDQRVAFIHKLDDDPSQSSELLSEAKKLNDSQAPK | SEQ ID NO:744 |
| Z13613 | VDAKYAKELEAARHEIRWLPNLTFDQRVAFIHKLRDDPSQSSELLSEAKKLNDSQAPK | SEQ ID NO:745 |
| Z13615 | VDAKYAKEAATAGHEIRWLPNLTFDQRVAFIHKLRDDPSQSSELLSEAKKLNDSQAPK | SEQ ID NO:746 |
| Z13616 | VDAKYAKEWQQAAHEIRWLPNLTFDQRVAFIRKLRDDPSQSSELLSEAKKLNDSQAPK | SEQ ID NO:747 |
| Z13617 | VDAKYAKEADQAGHEIRWLPNLTFDQRVAFIHKLRDDPSQSSELLSEAKKLNDSQAPK | SEQ ID NO:748 |
| Z13620 | VDAKYAKEQSKAAHEIRWLPNLTFDQRVAFIHKLRDDPSQSSELLSEAKKLNDSQAPK | SEQ ID NO:749 |
| Z13621 | VDAKYAKEADAAGHEIRWLPNLTFDQRVAFIHKLRDDPSQSSELLSEAKKLNDSQAPK | SEQ ID NO:750 |
| Z13622 | VDAKYAKEFMDAGHEIRWLPNLTFDQRVAFIHKLRDDPSQSSELLSEAKKLNDSQAPK | SEQ ID NO:751 |
| Z13624 | VDAKYAKESKQAAHEIRWLPNLTFDQRVAFIHKLRDDPSQSSELLSEAKKLNDSQAPK | SEQ ID NO:752 |
| Z13625 | VDAKYAKEVSDAAHEIRWLPNLTFDQRVAFIHKLRDDPSQSSELLSEAKKLNDSQAPK | SEQ ID NO:753 |
| Z13626 | VDAKYAKEADSASHEIRWLPNLTFDQRVAFIHKLRDDPSQSSELLSEAKKLNDSQAPK | SEQ ID NO:754 |
| Z13627 | VDAKYAKELMEAAHEIRWLPNLTFDQRVAFIHKLKDDPSQSSELLSEAKKLNDSQAPK | SEQ ID NO:755 |
| Z13628 | VDAKYAKELNTAAHEIRWLPNLTFDQRVAFIHKLKDDPSQSSELLSEAKKLNDSQAPK | SEQ ID NO:756 |

Figure 1CC

| Designation | Sequence | SEQ ID NO: |
|---|---|---|
| Z13629 | VDAKYAKEVHEAGHEIRWLPNLTFDQRVAFIHKLRDDPSQSSELLSEAKKLNDSQAPK | SEQ ID NO:757 |
| Z13633 | VDAKYAKESTAAAHEIRWLPNLTFDQRVAFIHKLRDDPSQSSELLSEAKKLNDSQAPK | SEQ ID NO:758 |
| Z13634 | VDAKYAKEWYNAAHEIRWLPNLTFDQRVAFIHKLRDDPSQSSELLSEAKKLNDSQAPK | SEQ ID NO:759 |
| Z13635 | VDAKYAKEWNDAAHEIRWLPNLTFDQRVAFIHKLRDDPSQSSELLSEAKKLNDSQAPK | SEQ ID NO:760 |
| Z13637 | VDAKYAKEVEVAKHEIRWLPNLTFDQRVAFIHKLDDDPSQSSELLSEAKKLNDSQAPK | SEQ ID NO:761 |
| Z13638 | VDAKYAKEFNFAAHEIRWLPNLTFDQRVAFIHKLRDDPSQSSELLSEAKKLNDSQAPK | SEQ ID NO:762 |
| Z13639 | VDAKYAKEHDSAAHEIRWLPNLTFDQRVAFIHKLRDDPSQSSELLSEAKKLNDSQAPK | SEQ ID NO:763 |
| Z13640 | VDAKYAKEWMDAAHEIRWLPNLTFDQRVAFIHKLRDDPSQSSELLSEAKKLNDSQAPK | SEQ ID NO:764 |
| Z13641 | VDAKYAKEFSAAGHEIRWLPNLTFDQRVAFIHKLRDDPSQSSELLSEAKKLNDSQAPK | SEQ ID NO:765 |
| Z13644 | VDAKYAKELNSAAHEIRWLPNLTFDQRVAFIHKLRDDPSQSSELLSEAKKLNDSQAPK | SEQ ID NO:766 |
| Z13645 | VDAKYAKEVDTAAHEIRWLPNLTFDQRVAFIHKLRDDPSQSSELLSEAKKLNDSQAPK | SEQ ID NO:767 |
| Z13648 | VDAKYAKESQIAGHEIRWLPNLTFDQRVAFIHKLRDDPSQSSELLSEAKKLNDSQAPK | SEQ ID NO:768 |
| Z13651 | VDAKYAKEVSAASHEIRWLPNLTFDQRVAFIHKLRDDPSQSSELLSEAKKLNDSQAPK | SEQ ID NO:769 |
| Z13652 | VDAKYAKEDQDAAHEIRWLPNLTFDQRVAFIHKLRDDPSQSSELLSEAKKLNDSQAPK | SEQ ID NO:770 |
| Z13654 | VDAKYAKELEAAKHEIRWLPNLTFDQRVAFIHKLRDDPSQSSELLSEAKKLNDSQAPK | SEQ ID NO:771 |
| Z13655 | VDAKYAKESKRAAHEIRWLPNLTFDQRVAFIHKLDDDPSQSSELLSEAKKLNDSQAPK | SEQ ID NO:772 |
| Z13656 | VDAKYAKEYVKAGHEIRWLPNLTFDQRVAFIRKLRDDPSQSSELLSEAKKLNDSQAPK | SEQ ID NO:773 |
| Z13657 | VDAKYAKEFSRAGHEIRWLPNLTFDQRVAFIHKLRDDPSQSSELLSEAKKLNDSQAPK | SEQ ID NO:774 |
| Z13659 | VDAKYAKEWQFAAHEIRWLPNLTFDQRVAFIHKLRDDPSQSSELLSEAKKLNDSQAPK | SEQ ID NO:775 |
| Z13663 | VDAKYAKEWQTAAHEIRWLPNLTFDQRVAFIHKLRDDPSQSSELLSEAKKLNDSQAPK | SEQ ID NO:776 |
| Z13664 | VDAKYAKELQEAAHEIRWLPNLTFDQRVAFIHKLRDDPSQSSELLSEAKKLNDSQAPK | SEQ ID NO:777 |
| Z13667 | VDAKYAKEYRAAAHEIRWLPNLTFDQRVAFIHKLRDDPSQSSELLSEAKKLNDSQAPK | SEQ ID NO:778 |
| Z13669 | VDAKYAKELASAGHEIRWLPNLTFDQRVAFIHKLRDDPSQSSELLSEAKKLNDSQAPK | SEQ ID NO:779 |
| Z13672 | VDAKYAKEVQSASHEIRWLPNLTFDQRVAFIHKLRDDPSQSSELLSEAKKLNDSQAPK | SEQ ID NO:780 |
| Z13674 | VDAKYAKEIEDAGHEIRWLPNLTFDQRVAFIHKLRDDPSQSSELLSEAKKLNDSQAPK | SEQ ID NO:781 |
| Z13675 | VDAKYAKENQAAAHEIRWLPNLTFDQRVAFIHKLRDDPSQSSELLSEAKKLNDSQAPK | SEQ ID NO:782 |
| Z13676 | VDAKYAKEATSAGHEIRWLPNLTFDQRVAFIVKLRDDPSQSSELLSEAKKLNDSQAPK | SEQ ID NO:783 |
| Z13678 | VDAKYAKEDQAAHEIRWLPNLTFDQRVAFIHKLRDDPSQSSELLSEAKKLNDSQAPK | SEQ ID NO:784 |

Figure 1DD

| Designation | Sequence | SEQ ID NO: |
|---|---|---|
| Z13684 | VDAKYAKEQNQAGHEIRWLPNLTFDQRVAFIHKLRDDPSQSSELLSEAKKLNDSQAPK | SEQ ID NO:785 |
| Z13688 | VDAKYAKEYTSAAHEIRWLPNLTFDQRVAFIHKLRDDPSQSSELLSEAKKLNDSQAPK | SEQ ID NO:786 |
| Z13691 | VDAKYAKEWDAAAHEIRWLPNLTFDQRVAFIHKLRDDPSQSSELLSEAKKLNDSQAPK | SEQ ID NO:787 |
| Z13692 | VDAKYAKEEMQAGHEIRWLPNLTFDQRVAFIHKLRDDPSQSSELLSEAKKLNDSQAPK | SEQ ID NO:788 |
| Z13694 | VDAKYAKELSDAAHEIRWLPNLTFDQRVAFIHKLNDDPSQSSELLSEAKKLNDSQAPK | SEQ ID NO:789 |
| Z13695 | VDAKYAKEIDAAKHEIRWLPNLTFDQRVAFIHKLDDDPSQSSELLSEAKKLNDSQAPK | SEQ ID NO:790 |
| Z13697 | VDAKYAKEAERAGHEIRWLPNLTFDQRVAFIRKLRDDPSQSSELLSEAKKLNDSQAPK | SEQ ID NO:791 |
| Z13706 | VDAKYAKEEDSAAHEIRWLPNLTFDQRVAFIHKLRDDPSQSSELLSEAKKLNDSQAPK | SEQ ID NO:792 |
| Z13708 | VDAKYAKEQKAAGHEIRWLPNLTFDQRVAFIHKLRDDPSQSSELLSEAKKLNDSQAPK | SEQ ID NO:793 |
| Z13710 | VDAKYAKEWDQAAHEIRWLPNLTFDQRVAFIHKLRDDPSQSSELLSEAKKLNDSQAPK | SEQ ID NO:794 |
| Z13711 | VDAKYAKEAKAAAHEIRWLPNLTFDQRVAFIHKLRDDPSQSSELLSEAKKLNDSQAPK | SEQ ID NO:795 |
| Z13714 | VDAKYAKELSAAHEIRWLPNLTFDQRVAFIHKLRDDPSEELLSEAKKLNDSQAPK | SEQ ID NO:796 |
| Z13716 | VDAKYAKETEAAKHEIRWLPNLTFDQRVAFIHKLRDDPSQSSELLSEAKKLNDSQAPK | SEQ ID NO:797 |
| Z13719 | VDAKYAKEAKSAAHEIRWLPNLTFDQRVAFIHKLRDDPSQSSELLSEAKKLNDSQAPK | SEQ ID NO:798 |
| Z13720 | VDAKYAKEQSAAAHEIRWLPNLTFDQRVAFIHKLNDDPSQSSELLSEAKKLNDSQAPK | SEQ ID NO:799 |
| Z13721 | VDAKYAKEKERAAHEIRWLPNLTFDQRVAFIHKLRDDPSQSSELLSEAKKLNDSQAPK | SEQ ID NO:800 |
| Z13725 | VDAKYAKEWDEAAHEIRWLPNLTFDQRVAFIHKLKDDPSQSSELLSEAKKLNDSQAPK | SEQ ID NO:801 |
| Z13727 | VDAKYAKEEKDAAHEIRWLPNLTFDQRVAFIHKLRDDPSQSSELLSEAKKLNDSQAPK | SEQ ID NO:802 |
| Z13728 | VDAKYAKEIENAAHEIRWLPNLTFDQRVAFIWKLRDDPSQSSELLSEAKKLNDSQAPK | SEQ ID NO:803 |
| Z13732 | VDAKYAKETKEAAHEIRWLPNLTFDQRVAFIHKLWDDPSQSSELLSEAKKLNDSQAPK | SEQ ID NO:804 |
| Z13735 | VDAKYAKELEAAKHEIRWLPNLTFDQRVAFIHKLNDDPSQSSELLSEAKKLNDSQAPK | SEQ ID NO:805 |
| Z13736 | VDAKYAKEWAEAAHEIRWLPNLTFDQRVAFIHKLRDDPSQSSELLSEAKKLNDSQAPK | SEQ ID NO:806 |
| Z13740 | VDAKYAKESQEAGHEIRWLPNLTFDQRVAFIHKLRDDPSQSSELLSEAKKLNDSQAPK | SEQ ID NO:807 |
| Z13742 | VDAKYAKELSTAAHEIRWLPNLTFDQRVAFIHKLRDDPSQSSELLSEAKKLNDSQAPK | SEQ ID NO:808 |
| Z13747 | VDAKYAKEIEEAGHEIRWLPNLTFDQRVAFIHKLRDDPSQSSELLSEAKKLNDSQAPK | SEQ ID NO:809 |
| Z13749 | VDAKYAKELQTASHEIRWLPNLTFDQRVAFIHKLRDDPSQSSELLSEAKKLNDSQAPK | SEQ ID NO:810 |
| Z13750 | VDAKYAKEQDSAAHEIRWLPNLTFDQRVAFIRKLRDDPSQSSELLSEAKKLNDSQAPK | SEQ ID NO:811 |
| Z13751 | VDAKYAKESASAGHEIRWLPNLTFDQRVAFIHKLRDDPSQSSELLSEAKKLNDSQAPK | SEQ ID NO:812 |

Figure 1EE

| Designation | Sequence | SEQ ID NO: |
|---|---|---|
| Z13752 | VDAKYAKEVAKASHEIRWLPNLTFDQRVAFIHKLRDDPSQSSELLSEAKKLNDSQAPK | SEQ ID NO:813 |
| Z13758 | VDAKYAKEVQEAAHEIRWLPNLTFDQRVAFIHKLWDDPSQSSELLSEAKKLNDSQAPK | SEQ ID NO:814 |
| Z13759 | VDAKYAKESYEAAHEIRWLPNLTFDQRVAFIHKLRDDPSQSSELLSEAKKLNDSQAPK | SEQ ID NO:815 |
| Z13760 | VDAKYAKETAEAGHEIRWLPNLTFDQRVAFIHKLRDDPSQSSELLSEAKKLNDSQAPK | SEQ ID NO:816 |
| Z13761 | VDAKYAKELEEAAHEIRWLPNLTFDQRVAFIHKLRDDPSQSSELLSEAKKLNDSQAPK | SEQ ID NO:817 |
| Z13771 | VDAKYAKEAAAAGHEIRWLPNLTFDQRVAFIHKLRDDPSQSSELLSEAKKLNDSQAPK | SEQ ID NO:818 |
| Z13773 | VDAKYAKEYVDAGHEIRWLPNLTFDQRVAFIRKLRDDPSQSSELLSEAKKLNDSQAPK | SEQ ID NO:819 |
| Z13776 | VDAKYAKEIQEAGHEIRWLPNLTFDQRVAFIHKLRDDPSQSSELLSEAKKLNDSQAPK | SEQ ID NO:820 |
| Z13777 | VDAKYAKESATAAHEIRWLPNLTFDQRVAFIHKLRDDPSQSSELLSEAKKLNDSQAPK | SEQ ID NO:821 |
| Z13780 | VDAKYAKEWMSAAHEIRWLPNLTFDQRVAFIHKLRDDPSQSSELLSEAKKLNDSQAPK | SEQ ID NO:822 |
| Z13782 | VDAKYAKEREQASHEIRWLPNLTFDQRVAFIHKLRDDPSQSSELLSEAKKLNDSQAPK | SEQ ID NO:823 |
| Z13783 | VDAKYAKEIEQAGHEIRWLPNLTFDQRVAFIHKLRDDPSQSSELLSEAKKLNDSQAPK | SEQ ID NO:824 |
| Z13786 | VDAKYAKEHNAAAHEIRWLPNLTFDQRVAFIHKLRDDPSQSSELLSEAKKLNDSQAPK | SEQ ID NO:825 |
| Z13792 | VDAKYAKEIEVAAHEIRWLPNLTFDQRVAFIHKLRDDPSQSSELLSEAKKLNDSQAPK | SEQ ID NO:826 |
| Z13796 | VDAKYAKERAEAAHEIRWLPNLTFDQRVAFIWKLRDDPSQSSELLSEAKKLNDSQAPK | SEQ ID NO:827 |
| Z13799 | VDAKYAKESELAAHEIRWLPNLTFDQRVAFIHKLRDDPSQSSELLSEAKKLNDSQAPK | SEQ ID NO:828 |
| Z13806 | VDAKYAKEYRAAGHEIRWLPNLTFDQRVAFIHKLRDDPSQSSELLSEAKKLNDSQAPK | SEQ ID NO:829 |
| Z13808 | VDAKYAKETANAAHEIRWLPNLTFDQRVAFIHKLRDDPSQSSELLSEAKKLNDSQAPK | SEQ ID NO:830 |
| Z13811 | VDAKYAKEWYEAAHEIRWLPNLTFDQRVAFIHKLRDDPSQSSELLSEAKKLNDSQAPK | SEQ ID NO:831 |
| Z13812 | VDAKYAKEEQEAAHEIRWLPNLTFDQRVAFIHKLRDDPSQSSELLSEAKKLNDSQAPK | SEQ ID NO:832 |
| Z13823 | VDAKYAKEHDDAAHEIRWLPNLTFDQRVAFIHKLRDDPSQSSELLSEAKKLNDSQAPK | SEQ ID NO:833 |
| Z13824 | VDAKYAKEWYSAAHEIRWLPNLTFDQRVAFIHKLRDDPSQSSELLSEAKKLNDSQAPK | SEQ ID NO:834 |
| Z13838 | VDAKYAKEISDAAHEIRWLPNLTFDQRVAFIHKLRDDPSQSSELLSEAKKLNDSQAPK | SEQ ID NO:835 |
| Z13840 | VDAKYAKEYTTAAHEIRWLPNLTFDQRVAFIHKLRDDPSQSSELLSEAKKLNDSQAPK | SEQ ID NO:836 |
| Z13842 | VDAKYAKEISQAAHEIRWLPNLTFDQRVAFIHKLRDDPSQSSELLSEAKKLNDSQAPK | SEQ ID NO:837 |
| Z13845 | VDAKYAKENDDAAHEIRWLPNLTFDQRVAFIHKLRDDPSQSSELLSEAKKLNDSQAPK | SEQ ID NO:838 |
| Z13846 | VDAKYAKESEIAGHEIRWLPNLTFDQRVAFIRKLRDDPSQSSELLSEAKKLNDSQAPK | SEQ ID NO:839 |
| Z13848 | VDAKYAKEQADAAHEIRWLPNLTFDQRVAFIHKLRDDPSQSSELLSEAKKLNDSQAPK | SEQ ID NO:840 |

Figure 1FF

| Designation | Sequence | SEQ ID NO: |
|---|---|---|
| Z13849 | VDAKYAKETESAAHEIRWLPNLTFDQRVAFIHKLRDDPSQSSELLSEAKKLNDSQAPK | SEQ ID NO:841 |
| Z13860 | VDAKYAKEISDAKHEIRWLPNLTFDQRVAFIHKLDDDPSQSSELLSEAKKLNDSQAPK | SEQ ID NO:842 |
| Z13865 | VDAKYAKEHLNAAHEIRWLPNLTFDQRVAFIHKLRDDPSQSSELLSEAKKLNDSQAPK | SEQ ID NO:843 |
| Z13866 | VDAKYAKEWLDAAHEIRWLPNLTFDQRVAFIHKLRDDPSQSSELLSEAKKLNDSQAPK | SEQ ID NO:844 |
| Z13875 | VDAKYAKENAAAAHEIRWLPNLTFDQRVAFIHKLRDDPSQSSELLSEAKKLNDSQAPK | SEQ ID NO:845 |
| Z13879 | VDAKYAKEAELAGHEIRWLPNLTFDQRVAFIRKLRDDPSQSSELLSEAKKLNDSQAPK | SEQ ID NO:846 |
| Z13480 | VDAKYAKEVTDAGHEIRWLPNLTFDQRVAFIEKLKDDPSQSSELLSEAKKLNDSQAPK | SEQ ID NO:847 |
| Z13481 | VDAKYAKELDSASHEIRWLPNLTFDQRVAFINKLLDDPSQSSELLSEAKKLNDSQAPK | SEQ ID NO:848 |
| Z13482 | VDAKYAKEINLAKHEIRWLPNLTFDQRVAFIEKLNDDPSQSSELLSEAKKLNDSQAPK | SEQ ID NO:849 |
| Z13483 | VDAKYAKESEVAKHEIRWLPNLTFDQRVAFIHKLSDDPSQSSELLSEAKKLNDSQAPK | SEQ ID NO:850 |
| Z13484 | VDAKYAKESAEAGHEIRWLPNLTFDQRVAFIHKLQDDPSQSSELLSEAKKLNDSQAPK | SEQ ID NO:851 |
| Z13485 | VDAKYAKEYSNAAHEIRWLPNLTFDQRVAFIDKLSDDPSQSSELLSEAKKLNDSQAPK | SEQ ID NO:852 |
| Z13487 | VDAKYAKETNNAGHEIRWLPNLTFDQRVAFIIKLRDDPSQSSELLSEAKKLNDSQAPK | SEQ ID NO:853 |
| Z13488 | VDAKYAKEVFAAHEIRWLPNLTFDQRVAFIEKLHDDPSQSSELLSEAKKLNDSQAPK | SEQ ID NO:854 |
| Z13489 | VDAKYAKEVELAGHEIRWLPNLTFDQRVAFIEKLHDDPSQSSELLSEAKKLNDSQAPK | SEQ ID NO:855 |
| Z13490 | VDAKYAKEVLKASHEIRWLPNLTFDQRVAFITKLQDDPSQSSELLSEAKKLNDSQAPK | SEQ ID NO:856 |
| Z13491 | VDAKYAKEIANAGHEIRWLPNLTFDQRVAFIRKLDDDPSQSSELLSEAKKLNDSQAPK | SEQ ID NO:857 |
| Z13493 | VDAKYAKEYMKAGHEIRWLPNLTFDQRVAFINKLRDDPSQSSELLSEAKKLNDSQAPK | SEQ ID NO:858 |
| Z13495 | VDAKYAKEVDVAGHEIRWLPNLTFDQRVAFITRKLRDDPSQSSELLSEAKKLNDSQAPK | SEQ ID NO:859 |
| Z13496 | VDAKYAKEHANAQHEIRWLPNLTFDQRVAFIHKLQDDPSQSSELLSEAKKLNDSQAPK | SEQ ID NO:860 |
| Z13497 | VDAKYAKEVDIASHEIRWLPNLTFDQRVAFIWKLRDDPSQSSELLSEAKKLNDSQAPK | SEQ ID NO:861 |
| Z13499 | VDAKYAKEEVFAAHEIRWLPNLTFDQRVAFIVKLRDDPSQSSELLSEAKKLNDSQAPK | SEQ ID NO:862 |
| Z13501 | VDAKYAKEFNTAAHEIRWLPNLTFDQRVAFINKLRDDPSQSSELLSEAKKLNDSQAPK | SEQ ID NO:863 |
| Z13502 | VDAKYAKEVDVAGHEIRWLPNLTFDQRVAFIRKLRDDPSQSSELLSEAKKLNDSQAPK | SEQ ID NO:864 |
| Z13503 | VDAKYAKEWSLAAHEIRWLPNLTFDQRVAFIVKLRDDPSQSSELLSEAKKLNDSQAPK | SEQ ID NO:865 |
| Z13505 | VDAKYAKELDDAAHEIRWLPNLTFDQRVAFIQKLQDDPSQSSELLSEAKKLNDSQAPK | SEQ ID NO:866 |
| Z13506 | VDAKYAKERHEAGHEIRWLPNLTFDQRVAFIRKLNDDPSQSSELLSEAKKLNDSQAPK | SEQ ID NO:867 |
| Z13507 | VDAKYAKEWETAGHEIRWLPNLTFDQRVAFIVKLSDDPSQSSELLSEAKKLNDSQAPK | SEQ ID NO:868 |

Figure 1GG

| Designation | Sequence | SEQ ID NO: |
|---|---|---|
| Z13508 | VDAKYAKERYWASHEIRWLPNLTFDQRVAFIHKLNDDPSQSSELLSEAKKLNDSQAPK | SEQ ID NO:869 |
| Z13512 | VDAKYAKEIDWAGHEIRWLPNLTFDQRVAFIHKLLDDPSQSSELLSEAKKLNDSQAPK | SEQ ID NO:870 |
| Z13515 | VDAKYAKEQSKAGHEIRWLPNLTFDQRVAFIHKLKDDPSQSSELLSEAKKLNDSQAPK | SEQ ID NO:871 |
| Z13518 | VDAKYAKEIEAAQHEIRWLPNLTFDQRVAFINKLRDDPSQSSELLSEAKKLNDSQAPK | SEQ ID NO:872 |
| Z13519 | VDAKYAKEHEQAAHEIRWLPNLTFDQRVAFIHKLVDDPSQSSELLSEAKKLNDSQAPK | SEQ ID NO:873 |
| Z13520 | VDAKYAKEAEQAGHEIRWLPNLTFDQRVAFINKLQDDPSQSSELLSEAKKLNDSQAPK | SEQ ID NO:874 |
| Z13522 | VDAKYAKEVDYAAHEIRWLPNLTFDQRVAFIHKLMDDPSQSSELLSEAKKLNDSQAPK | SEQ ID NO:875 |
| Z13525 | VDAKYAKEYSAAGHEIRWLPNLTFDQRVAFIEKLRDDPSQSSELLSEAKKLNDSQAPK | SEQ ID NO:876 |
| Z13561 | VDAKYAKELATASHEIRWLPNLTFDQRVAFIHKLRDDPSQSSELLSEAKKLNDSQAPK | SEQ ID NO:877 |
| Z13572 | VDAKYAKEYRVAGHEIRWLPNLTFDQRVAFIQKLRDDPSQSSELLSEAKKLNDSQAPK | SEQ ID NO:878 |
| Z13575 | VDAKYAKEVVSAKHEIRWLPNLTFDQRVAFIHKLDDDPSQSSELLSEAKKLNDSQAPK | SEQ ID NO:879 |
| Z13576 | VDAKYAKESAQAAHEIRWLPNLTFDQRVAFIRKLRDDPSQSSELLSEAKKLNDSQAPK | SEQ ID NO:880 |
| Z13584 | VDAKYAKEYSAAGHEIRWLPNLTFDQRVAFIWKLRDDPSQSSELLSEAKKLNDSQAPK | SEQ ID NO:881 |
| Z13589 | VDAKYAKEQKEAAAEIRWLPNLTFDQRVAFIHKLRDDPSQSSELLSEAKKLNDSQAPK | SEQ ID NO:882 |
| Z13590 | VDAKYAKEAAIAGKEIRWLPNLTFDQRVAFIHKLRDDPSQSSELLSEAKKLNDSQAPK | SEQ ID NO:883 |
| Z13591 | VDAKYAKEISKAKHEIRWLPNLTFDQRVAFIHKLDDDPSQSSELLSEAKKLNDSQAPK | SEQ ID NO:884 |
| Z13593 | VDAKYAKESVAAAHEIRWLPNLTFDQRVAFIWKLRDDPSQSSELLSEAKKLNDSQAPK | SEQ ID NO:885 |
| Z13595 | VDAKYAKEIQQAKHEITSAKHEIRWLPNLTFDQRVAFIHKLDDDPSQSSELLSEAKKLNDSQAPK | SEQ ID NO:886 |
| Z13599 | VDAKYAKEITSAKHEIRWLPNLTFDQRVAFIHKLDDDPSQSSELLSEAKKLNDSQAPK | SEQ ID NO:887 |
| Z13601 | VDAKYAKEQDVAAHEIRWLPNLTFDQRVAFIRKLRDDPSQSSELLSEAKKLNDSQAPK | SEQ ID NO:888 |
| Z13603 | VDAKYAKELERAAHEIRWLPNLTFDQRVAFIHKLKDDPSQSSELLSEAKKLNDSQAPK | SEQ ID NO:889 |
| Z13607 | VDAKYAKENQLAAHEIRWLPNLTFDQRVAFIHKLRDDPSQSSELLSEAKKLNDSQAPK | SEQ ID NO:890 |
| Z13608 | VDAKYAKEISQAKHEIRWLPNLTFDQRVAFIHKLDDDPSQSSELLSEAKKLNDSQAPK | SEQ ID NO:891 |
| Z13610 | VDAKYAKEIANASHEIRWLPNLTFDQRVAFIYKLRDDPSQSSELLSEAKKLNDSQAPK | SEQ ID NO:892 |
| Z13614 | VDAKYAKEWQAAAHEIRWLPNLTFDQRVAFIRKLRDDPSQSSELLSEAKKLNDSQAPK | SEQ ID NO:893 |
| Z13618 | VDAKYAKERKDAGHEIRWLPNLTFDQRVAFIHKLRDDPSQSSELLSEAKKLNDSQAPK | SEQ ID NO:894 |
| Z13619 | VDAKYAKEITQAKHEIRWLPNLTFDQRVAFIHKLDDDPSQSSELLSEAKKLNDSQAPK | SEQ ID NO:895 |
| Z13623 | VDAKYAKEFIQAGHEIRWLPNLTFDQRVAFIHKLRDDPSQSSELLSEAKKLNDSQAPK | SEQ ID NO:896 |

Figure 1HH

| Designation | Sequence | SEQ ID NO: |
|---|---|---|
| Z13630 | VDAKYAKEWNTASHEIRWLPNLTFDQRVAFIHKLRDDPSQSSELLSEAKKLNDSQAPK | SEQ ID NO:897 |
| Z13631 | VDAKYAKEKFVAAHEIRWLPNLTFDQRVAFIHKLKDDPSQSSELLSEAKKLNDSQAPK | SEQ ID NO:898 |
| Z13632 | VDAKYAKEADSAGAEIRWLPNLTFDQRVAFIHKLRDDPSQSSELLSEAKKLNDSQAPK | SEQ ID NO:899 |
| Z13636 | VDAKYAKESSVAAAEIRWLPNLTFDQRVAFIHKLRDDPSQSSELLSEAKKLNDSQAPK | SEQ ID NO:900 |
| Z13642 | VDAKYAKEVDLAGREIRWLPNLTFDQRVAFIHKLRDDPSQSSELLSEAKKLNDSQAPK | SEQ ID NO:901 |
| Z13643 | VDAKYAKEQERAAAEIRWLPNLTFDQRVAFIHKLRDDPSQSSELLSEAKKLNDSQAPK | SEQ ID NO:902 |
| Z13646 | VDAKYAKEIWQAKHEIRWLPNLTFDQRVAFIHKLDDDPSQSSELLSEAKKLNDSQAPK | SEQ ID NO:903 |
| Z13647 | VDAKYAKELNQAKHEIRWLPNLTFDQRVAFIHKLEDDPSQSSELLSEAKKLNDSQAPK | SEQ ID NO:904 |
| Z13649 | VDAKYAKELQQASHEIRWLPNLTFDQRVAFIHKLDDDPSQSSELLSEAKKLNDSQAPK | SEQ ID NO:905 |
| Z13650 | VDAKYAKEINQAKHEIRWLPNLTFDQRVAFIHKLDDDPSQSSELLSEAKKLNDSQAPK | SEQ ID NO:906 |
| Z13653 | VDAKYAKELVLAGHEIRWLPNLTFDQRVAFIHKLRDDPSQSSELLSEAKKLNDSQAPK | SEQ ID NO:907 |
| Z13658 | VDAKYAKELTSAAHEIRWLPNLTFDQRVAFIHKLRDDPSQSSELLSEAKKLNDSQAPK | SEQ ID NO:908 |
| Z13661 | VDAKYAKEWNAAAREIRWLPNLTFDQRVAFIHKLDDDPSQSSELLSEAKKLNDSQAPK | SEQ ID NO:909 |
| Z13662 | VDAKYAKEILHAKHEIRWLPNLTFDQRVAFIHKLDDDPSQSSELLSEAKKLNDSQAPK | SEQ ID NO:910 |
| Z13665 | VDAKYAKEVLTAKHEIRWLPNLTFDQRVAFIHKINDDPSQSSELLSEAKKLNDSQAPK | SEQ ID NO:911 |
| Z13666 | VDAKYAKENSKAAHEIRWLPNLTFDQRVAFIHKLADDPSQSSELLSEAKKLNDSQAPK | SEQ ID NO:912 |
| Z13668 | VDAKYAKEVMTAKHEIRWLPNLTFDQRVAFIHKLDDDPSQSSELLSEAKKLNDSQAPK | SEQ ID NO:913 |
| Z13671 | VDAKYAKEARDAAHEIRWLPNLTFDQRVAFIHKLSDDPSQSSELLSEAKKLNDSQAPK | SEQ ID NO:914 |
| Z13673 | VDAKYAKERSKAAHEIRWLPNLTFDQRVAFIHKLDDDPSQSSELLSEAKKLNDSQAPK | SEQ ID NO:915 |
| Z13677 | VDAKYAKEIYSAKHEIRWLPNLTFDQRVAFIHKLDDDPSQSSELLSEAKKLNDSQAPK | SEQ ID NO:916 |
| Z13679 | VDAKYAKEVQSAKHEIRWLPNLTFDQRVAFIHKLDDDPSQSSELLSEAKKLNDSQAPK | SEQ ID NO:917 |
| Z13680 | VDAKYAKETLEAAHEIRWLPNLTFDQRVAFIHKLDDDPSQSSELLSEAKKLNDSQAPK | SEQ ID NO:918 |
| Z13681 | VDAKYAKEQMRAAHEIRWLPNLTFDQRVAFIRKLRDDPSQSSELLSEAKKLNDSQAPK | SEQ ID NO:919 |
| Z13685 | VDAKYAKENKNAAHEIRWLPNLTFDQRVAFIHKLRDDPSQSSELLSEAKKLNDSQAPK | SEQ ID NO:920 |
| Z13687 | VDAKYAKETESAKHEIRWLPNLTFDQRVAFIHKLTDDPSQSSELLSEAKKLNDSQAPK | SEQ ID NO:921 |
| Z13689 | VDAKYAKETVQAKHEIRWLPNLTFDQRVAFIHKLDDDPSQSSELLSEAKKLNDSQAPK | SEQ ID NO:922 |
| Z13693 | VDAKYAKEIASAKHEIRWLPNLTFDQRVAFIRKLDDDPSQSSELLSEAKKLNDSQAPK | SEQ ID NO:923 |
| Z13698 | VDAKYAKEVMDAKHEIRWLPNLTFDQRVAFIHKLDDDPSQSSELLSEAKKLNDSQAPK | SEQ ID NO:924 |

Figure 1ll

| Designation | Sequence | SEQ ID NO: |
|---|---|---|
| Z13699 | VDAKYAKETDAAKHEIRWLPNLTFDQRVAFIHKLRDDPSQSSELLSEAKKLNDSQAPK | SEQ ID NO:925 |
| Z13701 | VDAKYAKELQIAKHEIRWLPNLTFDQRVAFIHKLDDDPSQSSELLSEAKKLNDSQAPK | SEQ ID NO:926 |
| Z13702 | VDAKYAKEWKDAAQEIRWLPNLTFDQRVAFIHKLRDDPSQSSELLSEAKKLNDSQAPK | SEQ ID NO:927 |
| Z13703 | VDAKYAKERDSAAHEIRWLPNLTFDQRVAFIRKLRDDPSQSSELLSEAKKLNDSQAPK | SEQ ID NO:928 |
| Z13704 | VDAKYAKEIAAAKHEIRWLPNLTFDQRVAFIHKLDDDPSQSSELLSEAKKLNDSQAPK | SEQ ID NO:929 |
| Z13707 | VDAKYAKESVKAKHEIRWLPNLTFDQRVAFIHKLRDDPSQSSELLSEAKKLNDSQAPK | SEQ ID NO:930 |
| Z13709 | VDAKYAKENERAKHEIRWLPNLTFDQRVAFIHKLDDDPSQSSELLSEAKKLNDSQAPK | SEQ ID NO:931 |
| Z13712 | VDAKYAKEYKRAGHEIRWLPNLTFDQRVAFIRKLRDDPSQSSELLSEAKKLNDSQAPK | SEQ ID NO:932 |
| Z13713 | VDAKYAKEVRAASHEIRWLPNLTFDQRVAFIHKLRDDPSQSSELLSEAKKLNDSQAPK | SEQ ID NO:933 |
| Z13717 | VDAKYAKEDKRAAHEIRWLPNLTFDQRVAFIRKLRDDPSQSSELLSEAKKLNDSQAPK | SEQ ID NO:934 |
| Z13718 | VDAKYAKESEKAGKEIRWLPNLTFDQRVAFIRKLRDDPSQSSELLSEAKKLNDSQAPK | SEQ ID NO:935 |
| Z13722 | VDAKYAKEINRAKHEIRWLPNLTFDQRVAFIHKLDDDPSQSSELLSEAKKLNDSQAPK | SEQ ID NO:936 |
| Z13724 | VDAKYAKETQQASHEIRWLPNLTFDQRVAFIHKLRDDPSQSSELLSEAKKLNDSQAPK | SEQ ID NO:937 |
| Z13729 | VDAKYAKENQSAAHEIRWLPNLTFDQRVAFIRKLRDDPSQSSELLSEAKKLNDSQAPK | SEQ ID NO:938 |
| Z13730 | VDAKYAKEAKQASHEIRWLPNLTFDQRVAFIVKLRDDPSQSSELLSEAKKLNDSQAPK | SEQ ID NO:939 |
| Z13731 | VDAKYAKEAAQAAHEIRWLPNLTFDQRVAFIHKLRDDPSQSSELLSEAKKLNDSQAPK | SEQ ID NO:940 |
| Z13733 | VDAKYAKEVQYASHEIRWLPNLTFDQRVAFIHKLRDDPSQSSELLSEAKKLNDSQAPK | SEQ ID NO:941 |
| Z13734 | VDAKYAKELRNAAHEIRWLPNLTFDQRVAFIHKLRDDPSQSSELLSEAKKLNDSQAPK | SEQ ID NO:942 |
| Z13737 | VDAKYAKEQRAAAHEIRWLPNLTFDQRVAFIHKLRDDPSQSSELLSEAKKLNDSQAPK | SEQ ID NO:943 |
| Z13739 | VDAKYAKEASEAAAEIRWLPNLTFDQRVAFIHKLRDDPSQSSELLSEAKKLNDSQAPK | SEQ ID NO:944 |
| Z13741 | VDAKYAKESVIAAHEIRWLPNLTFDQRVAFIHKLRDDPSQSSELLSEAKKLNDSQAPK | SEQ ID NO:945 |
| Z13744 | VDAKYAKEILRAKHEIRWLPNLTFDQRVAFIHKLRDDPSQSSELLSEAKKLNDSQAPK | SEQ ID NO:946 |
| Z13746 | VDAKYAKESKTAAHEIRWLPNLTFDQRVAFIQKLRDDPSQSSELLSEAKKLNDSQAPK | SEQ ID NO:947 |
| Z13748 | VDAKYAKELAEASHEIRWLPNLTFDQRVAFIHKLDDDPSQSSELLSEAKKLNDSQAPK | SEQ ID NO:948 |
| Z13753 | VDAKYAKEATTAKHEIRWLPNLTFDQRVAFIHKLRDDPSQSSELLSEAKKLNDSQAPK | SEQ ID NO:949 |
| Z13754 | VDAKYAKEIENAAHEIRWLPNLTFDQRVAFIHKLRDDPSQSSELLSEAKKLNDSQAPK | SEQ ID NO:950 |
| Z13755 | VDAKYAKEAKDAAHEIRWLPNLTFDQRVAFIRKLRDDPSQSSELLSEAKKLNDSQAPK | SEQ ID NO:951 |
| Z13757 | VDAKYAKERLEAAAEIRWLPNLTFDQRVAFIHKLRDDPSQSSELLSEAKKLNDSQAPK | SEQ ID NO:952 |

Figure 1JJ

| Designation | Sequence | SEQ ID NO: |
|---|---|---|
| Z13762 | VDAKYAKEQMEAAAEIRWLPNLTFDQRVAFIHKLRDDPSQSSELLSEAKKLNDSQAPK | SEQ ID NO:953 |
| Z13763 | VDAKYAKEVKTASHEIRWLPNLTFDQRVAFIRKLRDDPSQSSELLSEAKKLNDSQAPK | SEQ ID NO:954 |
| Z13764 | VDAKYAKESFEASHEIRWLPNLTFDQRVAFIQKLRDDPSQSSELLSEAKKLNDSQAPK | SEQ ID NO:955 |
| Z13765 | VDAKYAKEIKSAKHEIRWLPNLTFDQRVAFIHKLDDDPSQSSELLSEAKKLNDSQAPK | SEQ ID NO:956 |
| Z13766 | VDAKYAKEIKNAKHEIRWLPNLTFDQRVAFIHKLDDDPSQSSELLSEAKKLNDSQAPK | SEQ ID NO:957 |
| Z13768 | VDAKYAKELQEAKHEIRWLPNLTFDQRVAFIHKLDDDPSQSSELLSEAKKLNDSQAPK | SEQ ID NO:958 |
| Z13769 | VDAKYAKERQNAAHEIRWLPNLTFDQRVAFIRKLRDDPSQSSELLSEAKKLNDSQAPK | SEQ ID NO:959 |
| Z13770 | VDAKYAKEVLQAKHEIRWLPNLTFDQRVAFIHKLRDDPSQSSELLSEAKKLNDSQAPK | SEQ ID NO:960 |
| Z13772 | VDAKYAKEANVASHEIRWLPNLTFDQRVAFIHKLRDDPSQSSELLSEAKKLNDSQAPK | SEQ ID NO:961 |
| Z13774 | VDAKYAKELDAAKHEIRWLPNLTFDQRVAFIHKLDDDPSQSSELLSEAKKLNDSQAPK | SEQ ID NO:962 |
| Z13775 | VDAKYAKETASAAHEIRWLPNLTFDQRVAFIHKLNDDPSQSSELLSEAKKLNDSQAPK | SEQ ID NO:963 |
| Z13778 | VDAKYAKEWKQAASEIRWLPNLTFDQRVAFIHKLRDDPSQSSELLSEAKKLNDSQAPK | SEQ ID NO:964 |
| Z13779 | VDAKYAKETASASHEIRWLPNLTFDQRVAFIHKLQDDPSQSSELLSEAKKLNDSQAPK | SEQ ID NO:965 |
| Z13781 | VDAKYAKESIVAGHEIRWLPNLTFDQRVAFIHKLRDDPSQSSELLSEAKKLNDSQAPK | SEQ ID NO:966 |
| Z13784 | VDAKYAKEIKQAKHEIRWLPNLTFDQRVAFIHKLDDDPSQSSELLSEAKKLNDSQAPK | SEQ ID NO:967 |
| Z13785 | VDAKYAKEQATASHEIRWLPNLTFDQRVAFIRKLRDDPSQSSELLSEAKKLNDSQAPK | SEQ ID NO:968 |
| Z13787 | VDAKYAKELNAAKHEIRWLPNLTFDQRVAFIRKLRDDPSQSSELLSEAKKLNDSQAPK | SEQ ID NO:969 |
| Z13788 | VDAKYAKEVKRAGHEIRWLPNLTFDQRVAFIRKLRDDPSQSSELLSEAKKLNDSQAPK | SEQ ID NO:970 |
| Z13789 | VDAKYAKESRNAAHEIRWLPNLTFDQRVAFIHKLQDDPSQSSELLSEAKKLNDSQAPK | SEQ ID NO:971 |
| Z13791 | VDAKYAKESITASAEIRWLPNLTFDQRVAFIRKLRDDPSQSSELLSEAKKLNDSQAPK | SEQ ID NO:972 |
| Z13793 | VDAKYAKEAATAAHEIRWLPNLTFDQRVAFIHKLDDDPSQSSELLSEAKKLNDSQAPK | SEQ ID NO:973 |
| Z13794 | VDAKYAKEVYAAKHEIRWLPNLTFDQRVAFIHKLDDDPSQSSELLSEAKKLNDSQAPK | SEQ ID NO:974 |
| Z13795 | VDAKYAKEISRAKHEIRWLPNLTFDQRVAFIHKLDDDPSQSSELLSEAKKLNDSQAPK | SEQ ID NO:975 |
| Z13798 | VDAKYAKEYVTAAHEIRWLPNLTFDQRVAFIHKLRDDPSQSSELLSEAKKLNDSQAPK | SEQ ID NO:976 |
| Z13800 | VDAKYAKEHIDAGHEIRWLPNLTFDQRVAFIHKLRDDPSQSSELLSEAKKLNDSQAPK | SEQ ID NO:977 |
| Z13801 | VDAKYAKEILQAKHEIRWLPNLTFDQRVAFIHKLNDDPSQSSELLSEAKKLNDSQAPK | SEQ ID NO:978 |
| Z13802 | VDAKYAKENSQAKHEIRWLPNLTFDQRVAFIHKLINDDPSQSSELLSEAKKLNDSQAPK | SEQ ID NO:979 |
| Z13803 | VDAKYAKEYRVAAKEIRWLPNLTFDQRVAFIHKLRDDPSQSSELLSEAKKLNDSQAPK | SEQ ID NO:980 |

Figure 1KK

| Designation | Sequence | SEQ ID NO: |
|---|---|---|
| Z13804 | VDAKYAKEIYNAGHEIRWLPNLTFDQRVAFIRKLRDDPSQSSELLSEAKKLNDSQAPK | SEQ ID NO:981 |
| Z13805 | VDAKYAKESNEAAAEIRWLPNLTFDQRVAFIRKLRDDPSQSSELLSEAKKLNDSQAPK | SEQ ID NO:982 |
| Z13809 | VDAKYAKESQLAAAEIRWLPNLTFDQRVAFIRKLQDDPSQSSELLSEAKKLNDSQAPK | SEQ ID NO:983 |
| Z13810 | VDAKYAKELKEAGHEIRWLPNLTFDQRVAFIHKLQDDPSQSSELLSEAKKLNDSQAPK | SEQ ID NO:984 |
| Z13813 | VDAKYAKETRVASVEIRWLPNLTFDQRVAFIQKLNDDPSQSSELLSEAKKLNDSQAPK | SEQ ID NO:985 |
| Z13818 | VDAKYAKELRTAAHEIRWLPNLTFDQRVAFIHKLNDDPSQSSELLSEAKKLNDSQAPK | SEQ ID NO:986 |
| Z13820 | VDAKYAKEKTYAHFEIRWLPNLTFDQRVAFISKLWDDPSQSSELLSEAKKLNDSQAPK | SEQ ID NO:987 |
| Z13821 | VDAKYAKEEAQASHEIRWLPNLTFDQRVAFIHKLRDDPSQSSELLSEAKKLNDSQAPK | SEQ ID NO:988 |
| Z13822 | VDAKYAKEITSAAHEIRWLPNLTFDQRVAFIHKLRDDPSQSSELLSEAKKLNDSQAPK | SEQ ID NO:989 |
| Z13825 | VDAKYAKEVKTASHEIRWLPNLTFDQRVAFIHKLKDDPSQSSELLSEAKKLNDSQAPK | SEQ ID NO:990 |
| Z13826 | VDAKYAKETKVAAHEIRWLPNLTFDQRVAFIHKLRDDPSQSSELLSEAKKLNDSQAPK | SEQ ID NO:991 |
| Z13829 | VDAKYAKEDLVAQHEIRWLPNLTFDQRVAFIRKLRDDPSQSSELLSEAKKLNDSQAPK | SEQ ID NO:992 |
| Z13830 | VDAKYAKETQTAFNEIRWLPNLTYDQRAAFILKLWDDPSQSSELLSEAKKLNDSQAPK | SEQ ID NO:993 |
| Z13831 | VDAKYAKEIKDAGHEIRWLPNLTFDQRVAFIRKLRDDPSQSSELLSEAKKLNDSQAPK | SEQ ID NO:994 |
| Z13836 | VDAKYAKEYKEAGHEIRWLPNLTFDQRVAFIVKLRDDPSQSSELLSEAKKLNDSQAPK | SEQ ID NO:995 |
| Z13839 | VDAKYAKEALAAHEIRWLPNLTFDQRVAFIHKLKDDPSQSSELLSEAKKLNDSQAPK | SEQ ID NO:996 |
| Z13843 | VDAKYAKEQERAAHEIRWLPNLTFDQRVAFIRKLRDDPSQSSELLSEAKKLNDSQAPK | SEQ ID NO:997 |
| Z13844 | VDAKYAKEWFDAAHEIRWLPNLTFDQRVAFIRKLRDDPSQSSELLSEAKKLNDSQAPK | SEQ ID NO:998 |
| Z13847 | VDAKYAKEIIQAKHEIRWLPNLTFDQRVAFIHKLDDDPSQSSELLSEAKKLNDSQAPK | SEQ ID NO:999 |
| Z13850 | VDAKYAKELTNAKHEIRWLPNLTFDQRVAFIHKLDDDPSQSSELLSEAKKLNDSQAPK | SEQ ID NO:1000 |
| Z13851 | VDAKYAKEIQLAKHEIRWLPNLTFDQRVAFIHKLRDDPSQSSELLSEAKKLNDSQAPK | SEQ ID NO:1001 |
| Z13854 | VDAKYAKEIHDAKHEIRWLPNLTFDQRVAFIHKLQDDPSQSSELLSEAKKLNDSQAPK | SEQ ID NO:1002 |
| Z13869 | VDAKYAKEVKIASHEIRWLPNLTFDQRVAFIHKLRDDPSQSSELLSEAKKLNDSQAPK | SEQ ID NO:1003 |
| Z13870 | VDAKYAKEQHSAAHEIRWLPNLTFDQRVAFIRKLRDDPSQSSELLSEAKKLNDSQAPK | SEQ ID NO:1004 |
| Z13872 | VDAKYAKEVFAASAEIRWLPNLTFDQRVAFIRKLRDDPSQSSELLSEAKKLNDSQAPK | SEQ ID NO:1005 |
| Z13874 | VDAKYAKETDLAGHEIRWLPNLTFDQRVAFIRKLRDDPSQSSELLSEAKKLNDSQAPK | SEQ ID NO:1006 |
| Z13877 | VDAKYAKEANFAGHEIRWLPNLTFDQRVAFIRKLRDDPSQSSELLSEAKKLNDSQAPK | SEQ ID NO:1007 |
| Z13878 | VDAKYAKEFETAGHEIRWLPNLTFDQRVAFITKLWDPSQSSELLSEAKKLNDSQAPK | SEQ ID NO:1008 |

Figure 1LL

| Designation | Sequence | SEQ ID NO: |
|---|---|---|
| Z13880 | VDAKYAKEVNLAKHEIRWLPNLTFDQRVAFIHKLDDPSQSSELLSEAKKLNDSQAPK | SEQ ID NO:1009 |
| Z13881 | VDAKYAKEADTAAHEIRWLPNLTFDQRVAFTYKLRDDPSQSSELLSEAKKLNDSQAPK | SEQ ID NO:1010 |
| Z13882 | VDAKYAKEFVDAGHEIRWLPNLTFDQRVAFIQKLRDDPSQSSELLSEAKKLNDSQAPK | SEQ ID NO:1011 |
| Z13883 | VDAKYAKEDHKAEHEIRWLPNLTFDQRVAFIHKLRDDPSQSSELLSEAKKLNDSQAPK | SEQ ID NO:1012 |
| Z13884 | VDAKYAKETVDAGHEIRWLPNLTFDQRVAFIHKLADDPSQSSELLSEAKKLNDSQAPK | SEQ ID NO:1013 |
| Z13885 | VDAKYAKESQRAGHEIRWLPNLTFDQRVAFITKLRDDPSQSSELLSEAKKLNDSQAPK | SEQ ID NO:1014 |
| Z13886 | VDAKYAKEWSSAAHEIRWLPNLTFDQRVAFIHKLQDDPSQSSELLSEAKKLNDSQAPK | SEQ ID NO:1015 |
| Z13887 | VDAKYAKEVAVAGHEIRWLPNLTYDQRVAFIVKLRDDPSQSSELLSEAKKLNDSQAPK | SEQ ID NO:1016 |
| Z13888 | VDAKYAKESAEAGHEIRWLPNLTFDQRVAFIEKLRDDPSQSSELLSEAKKLNDSQAPK | SEQ ID NO:1017 |
| Z13889 | VDAKYAKEAVAAGHEIRWLPNLTFDQRVAFIHKLNDDPSQSSELLSEAKKLNDSQAPK | SEQ ID NO:1018 |
| Z13890 | VDAKYAKEFQIAGHEIRWLPNLTFDQRVAFINKLRDDPSQSSELLSEAKKLNDSQAPK | SEQ ID NO:1019 |
| Z13891 | VDAKYAKELMVAKHEIRWLPNLTFDQRVAFIHKLDDDPSQSSELLSEAKKLNDSQAPK | SEQ ID NO:1020 |
| Z13892 | VDAKYAKEYDSAAHEIRWLPNLTFDQRVAFILKLRDDPSQSSELLSEAKKLNDSQAPK | SEQ ID NO:1021 |
| Z13893 | VDAKYAKEVLEAKHEIRWLPNLTFDQRVAFIHKLDDDPSQSSELLSEAKKLNDSQAPK | SEQ ID NO:1022 |
| Z13894 | VDAKYAKESIAASHEIRWLPNLTFDQRVAFIHKLRDDPSQSSELLSEAKKLNDSQAPK | SEQ ID NO:1023 |
| Z13895 | VDAKYAKEVAEAGHEIRWLPNLTFDQRVAFISKLRDDPSQSSELLSEAKKLNDSQAPK | SEQ ID NO:1024 |
| Z13896 | VDAKYAKEQAKAAHEIRWLPNLTFDQRVAFIHKLNDDPSQSSELLSEAKKLNDSQAPK | SEQ ID NO:1025 |
| Z13897 | VDAKYAKERDDAAHEIRWLPNLTFDQRVAFIEKLRDDPSQSSELLSEAKKLNDSQAPK | SEQ ID NO:1026 |
| Z13898 | VDAKYAKEAKDASHEIRWLPNLTFDQRVAFIHKLRDDPSQSSELLSEAKKLNDSQAPK | SEQ ID NO:1027 |
| Z13899 | VDAKYAKEASSAAHEIRWLPNLTFDQRVAFIQKLRDDPSQSSELLSEAKKLNDSQAPK | SEQ ID NO:1028 |
| Z13900 | VDAKYAKEWMEASHEIRWLPNLTFDQRVAFIVKLRDDPSQSSELLSEAKKLNDSQAPK | SEQ ID NO:1029 |
| Z13901 | VDAKYAKEQKNAAHEIRWLPNLTFDQRVAFIEKLRDDPSQSSELLSEAKKLNDSQAPK | SEQ ID NO:1030 |
| Z13902 | VDAKYAKEIENAKHEIRWLPNLTFDQRVAFIHKLDDDPSQSSELLSEAKKLNDSQAPK | SEQ ID NO:1031 |
| Z13903 | VDAKYAKEVNRASHEIRWLPNLTFDQRVAFIHKLLDDPSQSSELLSEAKKLNDSQAPK | SEQ ID NO:1032 |
| Z13904 | VDAKYAKERLLAGHEIRWLPNLTFDQRVAFINKLRDDPSQSSELLSEAKKLNDSQAPK | SEQ ID NO:1033 |
| Z13906 | VDAKYAKEVSIAGHEIRWLPNLTFDQRVAFIRKLRDDPSQSSELLSEAKKLNDSQAPK | SEQ ID NO:1034 |
| Z13907 | VDAKYAKEKEVAAHEIRWLPNLTFDQRVAFIHKLDDDPSQSSELLSEAKKLNDSQAPK | SEQ ID NO:1035 |
| Z13908 | VDAKYAKESERASHEIRWLPNLTFDQRVAFIHKLRDDPSQSSELLSEAKKLNDSQAPK | SEQ ID NO:1036 |

Figure 1MM

| Designation | Sequence | SEQ ID NO: |
|---|---|---|
| Z13909 | VDAKYAKEWNEAAHEIRWLPNLTFDQRVAFIHKLRDDPSQSSELLSEAKKLNDSQAPK | SEQ ID NO:1037 |
| Z13910 | VDAKYAKENVDAAHEIRWLPNLTFDQRVAFIHKLRDDPSQSSELLSEAKKLNDSQAPK | SEQ ID NO:1038 |
| Z13911 | VDAKYAKEADAASHEIRWLPNLTFDQRVAFIRKLRDDPSQSSELLSEAKKLNDSQAPK | SEQ ID NO:1039 |
| Z13912 | VDAKYAKELESASHEIRWLPNLTFDQRVAFIHKLIDDPSQSSELLSEAKKLNDSQAPK | SEQ ID NO:1040 |
| Z13913 | VDAKYAKEEQLAAHEIRWLPNLTFDQRVAFIRKLRDDPSQSSELLSEAKKLNDSQAPK | SEQ ID NO:1041 |
| Z13914 | VDAKYAKEFELAGHEIRWLPNLTFDQRVAFIHKLDDDPSQSSELLSEAKKLNDSQAPK | SEQ ID NO:1042 |
| Z13915 | VDAKYAKEAFVAQHEIRWLPNLTYDQRVAFIVKLRDDPSQSSELLSEAKKLNDSQAPK | SEQ ID NO:1043 |
| Z13916 | VDAKYAKEALKASHEIRWLPNLTFDQRVAFINKLRDDPSQSSELLSEAKKLNDSQAPK | SEQ ID NO:1044 |
| Z13917 | VDAKYAKELERAGHEIRWLPNLTFDQRVAFIKKLTDDPSQSSELLSEAKKLNDSQAPK | SEQ ID NO:1045 |
| Z13918 | VDAKYAKEVEWAKHEIRWLPNLTFDQRVAFIHKLQDDPSQSSELLSEAKKLNDSQAPK | SEQ ID NO:1046 |
| Z13919 | VDAKYAKEKASAQHEIRWLPNLTFDQRVAFIHKLDDDPSQSSELLSEAKKLNDSQAPK | SEQ ID NO:1047 |
| Z13920 | VDAKYAKETEIAKHEIRWLPNLTFDQRVAFIHKLTDDPSQSSELLSEAKKLNDSQAPK | SEQ ID NO:1048 |
| Z13921 | VDAKYAKEVNLAAHEIRWLPNLTFDQRVAFIHKLRDDPSQSSELLSEAKKLNDSQAPK | SEQ ID NO:1049 |
| Z13922 | VDAKYAKEAEAAHEIRWLPNLTFDQRVAFIHKLRDDPSQSSELLSEAKKLNDSQAPK | SEQ ID NO:1050 |
| Z13923 | VDAKYAKETDRAKHEIRWLPNLTFDQRVAFIHKLRDDPSQSSELLSEAKKLNDSQAPK | SEQ ID NO:1051 |
| Z13925 | VDAKYAKEFAQAGHEIRWLPNLTFDQRVAFIRKLRDDPSQSSELLSEAKKLNDSQAPK | SEQ ID NO:1052 |
| Z13926 | VDAKYAKETDEASHEIRWLPNLTFDQRVAFIQKLRDDPSQSSELLSEAKKLNDSQAPK | SEQ ID NO:1053 |
| Z13927 | VDAKYAKENADAGHEIRWLPNLTFDQRVAFIQKLRDDPSQSSELLSEAKKLNDSQAPK | SEQ ID NO:1054 |
| Z13928 | VDAKYAKESTQAAHEIRWLPNLTFDQRVAFIHKLQDDPSQSSELLSEAKKLNDSQAPK | SEQ ID NO:1055 |
| Z13929 | VDAKYAKEQALAAHEIRWLPNLTFDQRVAFIHKLNDDPSQSSELLSEAKKLNDSQAPK | SEQ ID NO:1056 |
| Z13930 | VDAKYAKEAHAASHEIRWLPNLTFDQRVAFIHKLDDDPSQSSELLSEAKKLNDSQAPK | SEQ ID NO:1057 |
| Z13932 | VDAKYAKEVDNAGHEIRWLPNLTFDQRVAFIQKLRDDPSQSSELLSEAKKLNDSQAPK | SEQ ID NO:1058 |
| Z13993 | VDAKYAKEAGRAAHEIRWLPNLTFDQRVAFIWKLRDDPSQSSELLSEAKKLNDSQAPK | SEQ ID NO:1059 |
| Z11948 | AEAKYAKEQDAAAHEIRWLPNLTFDQRVAFIHKLADDPSQSSELLSEAKKLNDSQAPK | SEQ ID NO:1060 |
| Z11946 | AEAKYAKEFESAAHEIRWLPNLTYDQRVAFIHKLSDDPSQSSELLSEAKKLNDSQAPK | SEQ ID NO:1061 |
| Z11947 | AEAKYAKEWMRAAHEIRWLPNLTFDQRVAFIHKLEDDPSQSSELLSEAKKLNDSQAPK | SEQ ID NO:1062 |
| PP013 | LAFAKEAANAELDSYGVSDFYKRLIDKAKTVEGVEALKDAILAALP | SEQ ID NO:1063 |
| Z03638 | AEAKYAKELGWATWEIFNLPNLTGVQVKAFIDKLRDDPSQSSELLSEAKKLNDSQAPK | SEQ ID NO:1064 |

Figure 1NN

| Designation | Sequence | SEQ ID NO: |
|---|---|---|
| Human αFcRn | AESHLSLLYHLTAVSSPAPGTPAFWVSGWLGPQQYLSYNSLRGEAEPCGAWVWENQVSWYWEKE TTDLRIKEKLFLEAFKALGGKGPYTLQGLLGCELGPDNTSVPTAKFALNGEEFMNFDLKQGTWG GDWPEALAISQRWQQQDKAANKELTFLLFSCPHRLREHLERGRGNLEWKEPPSMRLKARPSSPG FSVLTCSAFSFYPPELQLRFLRNGLAAGTGQGDFGPNSDGSFHASSSLTVKSGDEHHYCCIVQH AGLAQPLRVEL | SEQ ID NO:1065 |
| Human B2M | IQRTPKIQVYSRHPAENGKSNFLNCYVSGFHPSDIEVDLLKNGERIEKVEHSDLSFSKDWSFYL LYYTEFTPTEKDEYACRVNHVTLSQPKIVKWDRDM | SEQ ID NO:1066 |
| Murine B2M | IQKTPQIQVYSRHPPENGKPNILNCYVTQFHPPHIEIQMLKNGKKIPKVEMSDMSFSKDWSFYI LAHTEFTPTETDTYACRVKHASMAEPKTVYWDRDM | SEQ ID NO:1067 |
| hFcRn-eGFP | MGVPRPQPWALGLLLFLLPGSLGAESHLSLLYHLTAVSSPAPGTPAFWVSGWLGPQQYLSYNSL RGEAEPCGAWVWENQVSWYWEKETTDLRIKEKLFLEAFKALGGKGPYTLQGLLGCELGPDNTSV PTAKFALNGEEFMNFDLKQGTWGGDWPEALAISQRWQQQDKAANKELTFLLFSCPHRLREHLER GRGNLEWKEPPSMRLKARPSSPGFSVLTCSAFSFYPPELQLRFLRNGLAAGTGQGDFGPNSDGS FHASSSLTVKSGDEHHYCCIVQHAGLAQPLRVELESPAKSSVLVVGIVIGVLLLTAAAVGGALL WRRMRSGLPAPWISLRGDDTGVLLPTPGEAQDADLKDVNVIPATA | SEQ ID NO:1068 |
| mFcRn-eGFP | MGMPLPWALSLLLVLLPQTWGSETRPPLMYHLTAVSNPSTGLPSFWATGWLGPQQYLTYNSLRQ EADPCGAWMMENQVSWYWEKETTDLKSKEQLFLEALKTLEKILNGQKRGTYTLQGLLGCELASD NSSVPTAVFALNGEEFMKFNPRIGNWTGEWPETEIVANLWMKQPDAARKESEFLLNSCPERLLG HLERGRRNLEWKEPPSMRLKARPGNSGSSVLTCAAFSFYPPELKFRFLRNGLASGSGNCSTGPN GDGSFHAWSLLEVKRGDEHHYQCQVEHEGLAQPLTVDLDSSARSSVPVVGIVLGLLLVVAIAG GVLLWGRMRSGLPAPWLSLSGDDSGDLLPGGNLPPEAEPQGANAFPATS | SEQ ID NO:1069 |
| Murine αFcRn | SETRPPLMYHLTAVSNPSTGLPSFWATGWLGPQQYLTYNSLRQEADPCGAWMMENQVSWYWEKE TTDLKSKEQLFLEALKTLEKILNGQKRGTYTLQGLLGCELASDNSSVPTAVFALNGEEFMKFNP RIGNWTGEWPETEIVANLWMKQPDAARKESEFLLNSCPERLLGHLERGRRNLEWKEPPSMRLKA RPGNSGSSVLTCAAFSFYPPELKFRFLRNGLASGSGNCSTGPNGDGSFHAWSLLEVKRGDEHHY QCQVEHEGLAQPLTVDL | SEQ ID NO:1070 |

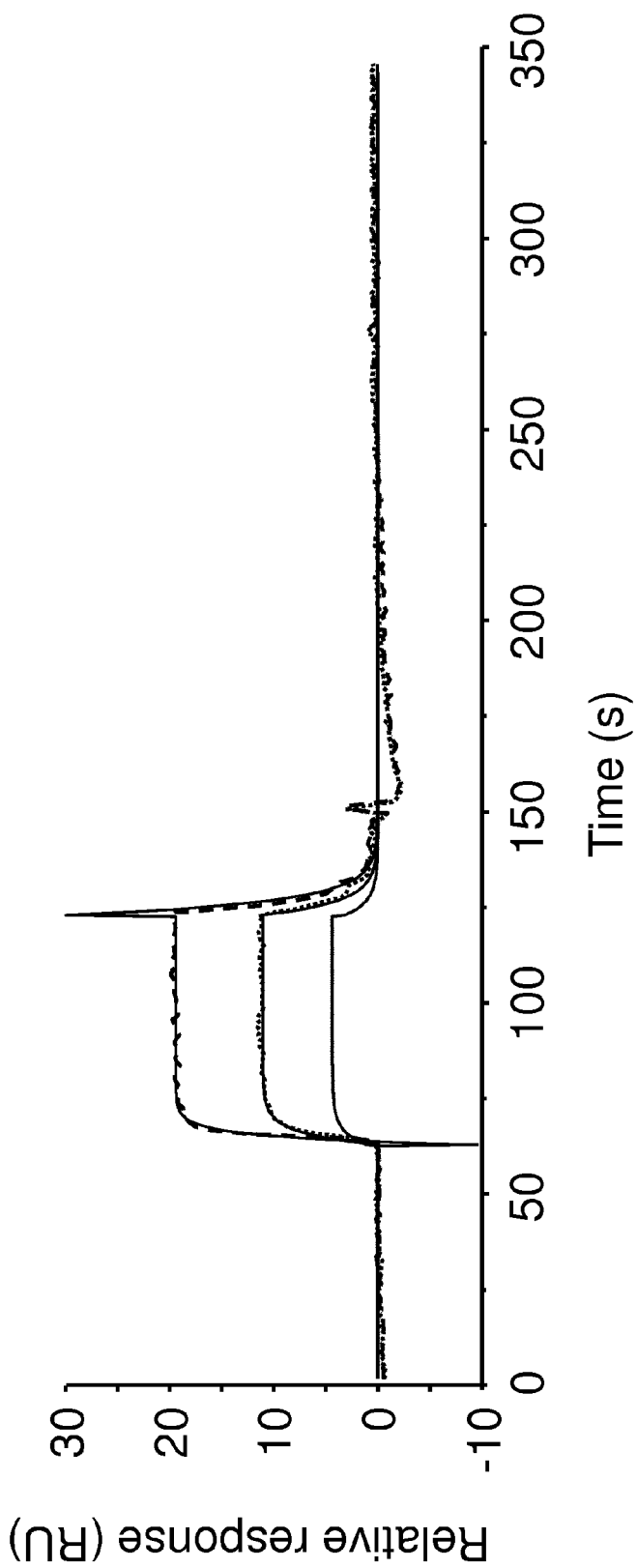

POLYPEPTIDES

CROSS-REFERENCE TO RELATED APPLICATIONS

This application is a U.S. National Stage application of PCT/EP2014/055299 filed Mar. 17, 2014, which claims priority from European Patent Application No. 13159500.1, filed Mar. 15, 2013, and U.S. Provisional Application No. 61/787,305 filed Mar. 15, 2013, all of which are incorporated by reference in their entirety.

TECHNICAL FIELD OF THE INVENTION

The present disclosure relates to a class of engineered polypeptides having a binding affinity for the neonatal Fc receptor (in the following referred to as FcRn). The present disclosure also relates to the use of such an FcRn binding polypeptide as an agent for modifying pharmacokinetic and pharmacodynamic properties of a biomolecule, e.g. a pharmaceutical, and as a therapeutic agent.

BACKGROUND

The neonatal Fc receptor (FcRn) is a heterodimeric protein consisting of a transmembrane MHC class I-like heavy chain (FcRn α-chain) and the β2-microglobulin light chain, the latter also forming a part of MHC class I molecules (Simister and Mostov (1989) Nature 337:184-7; Burmeister et al. (1994) Nature 372:379-83).

FcRn is predominantly located in endosomes and is able to bind to serum albumin and immunoglobulin G (IgG) at pH≤6.5 and release them at pH≥7.0 (reviewed in Roopenian (2007) Nat Rev Immunol 7:715-25).

FcRn carries out several distinct tasks in mammals (reviewed in Roopenian, supra). FcRn is involved in recycling of endocytosed IgG and serum albumin, thus avoiding their degradation in the lysosome, giving them longer half-life and higher availability in the blood than other serum proteins. When IgG, serum albumin and other serum proteins are passively pinocytosed by cells in contact with blood, the pH becomes gradually lower in the formed endosomes, which permits the binding of IgG and serum albumin to FcRn. The receptor is then, together with its bound ligand, transported via recycling endosomes back to the plasma membrane. After returning to the plasma membrane, the pH increases to above 7, at which point the bound ligand is released.

FcRn is also recognized for its ability to transport IgG over barriers such as the placenta, the upper airway epithelium, the blood-brain barrier and the proximal small intestine.

In mammals, the properties of FcRn are used to transcytose IgG from a mother to a fetus via the placenta, and to transcytose IgG from a mother's milk to the blood stream of an infant in the proximal small intestine.

The expression pattern of FcRn differs between species. However, FcRn is widely expressed by cells in the blood brain barrier, upper airway epithelium, kidneys and vascular endothelia, and by antigen presenting cells as well as by other cells of hematopoietic origin in most species (reviewed in Roopenian (2007), supra).

Antibodies and peptides with affinity towards FcRn (Liu et al. (2007) J Immunol 179:2999-3011, Mezo et al. (2008) Proc Natl Acad Sci USA 105:2337-42) and β2-microglobulin (Getman and Balthasar (2005) J Pharm Sci 94:718-29) have been developed with a view to inhibit the binding between endogenous IgG and FcRn. Another approach has been to mutate the Fc region of the IgG to get a higher affinity for FcRn (Petkova et al. (2006) Int Immunol 18:1759-69, Vaccaro et al. (2005) Nat Biotechnol 23:1283-8).

Fusion to the Fc domain or to albumin is a widely used strategy to increase the in vivo half-life of proteins. However, the large size of such fusion proteins adversely affects tissue penetration and reduces the specificity to the fusion partner (Valles et al. (2011) J Interferon Cytokine Res 32:178-184). On the other hand, mutations have been made in the Fc fragment of antibodies administered to non human primates to prolong half-life (Hinton et al. (2004) J Biol Chem 279:6213-6). However, this approach is only limited in use to therapeutic antibodies, and cannot be extrapolated to other therapeutic proteins unless the proteins in question are fused to Fc fragments, which also results in large size molecules. A number of chemical and recombinant methods have been devised to improve protein half-life, such as PEGylation and genetic fusions of the protein to the Fc domain of IgG or albumin (reviewed in Schellenberger et al. (2009) Nat Biotechnol 21:1186-1190). PEGylation of proteins has been reported to decrease their potency and contribute to their immunoreactivity.

Fc-fusion proteins have also been used for oral and pulmonary delivery mediated by the FcRn (Low et al., (2005) Human reproduction July; 20(7):1805-13), however similar problems relating to tissue penetration and reduced specificity remain, due to the size of the fusion molecules.

Hence, there is large need in the field for the continued provision of molecules with high affinity for FcRn. In particular, small binding molecules are needed that, when present as a fusion partner, do not adversely affect the properties of the molecules they are fused to and do not contribute to immunoreactivity.

SUMMARY OF THE INVENTION

It is an object of the present disclosure to provide new FcRn binding agents for use in modifying pharmacokinetic and/or pharmacodynamic properties of a biomolecule, e.g. a pharmaceutical.

It is also an object of the present disclosure to provide new FcRn binding agents for use as therapeutic agents in their own right, alone or as combination treatment.

It is an object of the present disclosure to provide a molecule allowing for efficient targeting of FcRn, while alleviating the above-mentioned and other drawbacks of current therapies.

These and other objects which are evident to the skilled person from the present disclosure are met by different aspects of the invention as claimed in the appended claims and as generally disclosed herein.

Thus, in the first aspect of the disclosure, there is provided a neonatal Fc receptor (FcRn) binding polypeptide, comprising an FcRn binding motif, BM, which motif consists of the amino acid sequence $$\text{EX}_2 \text{ X}_3 \text{ X}_4 \text{ AX}_6 \text{ X}_7 \text{ EIR WLPNLX}_{16} \text{ X}_{17} \text{ X}_{18} \text{ QR}$$
$$\text{X}_{21} \text{ AFIX}_{25} \text{ X}_{26}\text{LX}_{28} \text{ X}_{29}$$

(SEQ ID NO: 1075)

wherein, independently from each other, $X_2$ is selected from A, D, E, F, H, I, K, L, N, Q, R, S, T, V, W and Y;

$X_3$ is selected from A, D, E, F, G, H, I, K, L, M, N, Q, R, S, T, V, W and Y;

$X_4$ is selected from A, D, E, F, G, H, I, K, L, N, Q, R, S, T, V, W and Y;

$X_6$ is selected from A, D, E, F, G, H, I, K, L, N, Q, R, S, T, V, W and Y;

$X_7$ is selected from A, F, H, I, K, L, N, Q, R, S, T, V, W and Y;

$X_{16}$ is selected from N and T;

$X_{17}$ is selected from F, W and Y;

$X_{18}$ is selected from A, D, E and N;

$X_{21}$ is selected from A, S, V and W;

$X_{25}$ is selected from A, D, E, F, G, H, I, K, L, N, Q, R, S, T, V, W and Y;

$X_{26}$ is selected from K and S;

$X_{28}$ is selected from A, D, E, F, H, I, K, L, N, Q, R, S, T, V, W and Y; and $X_{29}$ is selected from D and R.

The above definition of a class of sequence related, FcRn binding polypeptides is based on a statistical analysis of a number of random polypeptide variants of a parent scaffold, that were selected for their interaction with FcRn in several different selection experiments. The identified FcRn binding motif, or "BM", corresponds to the target binding region of the parent scaffold, which region constitutes two alpha helices within a three-helical bundle protein domain. In the parent scaffold, the varied amino acid residues of the two BM helices constitute a binding surface for interaction with the constant Fc part of antibodies. In the present disclosure, the random variation of binding surface residues and subsequent selection of variants have replaced the Fc interaction capacity with a capacity for interaction with FcRn.

In one embodiment of said FcRn binding polypeptide, the BM consists of the amino acid sequence (SEQ ID NO: 1076)
EX$_2$ X$_3$ X$_4$ AX$_6$ X$_7$ EIR WLPNLTX$_{17}$ X$_{18}$ QR

X$_{21}$ AFIX$_{25}$ KLX$_{28}$ D wherein, independently from each other, $X_2$ is selected from A, D, E, F, H, I, K, L, N, Q, R, S, T, V, W and Y;

$X_3$ is selected from A, D, E, F, G, H, I, K, L, M, N, Q, R, S, T, V, W and Y;

$X_4$ is selected from A, D, E, F, G, H, I, K, L, N, Q, R, S, T, V, W and Y;

$X_6$ is selected from A, D, E, F, G, H, I, K, L, N, Q, R, S, T, V, W and Y;

$X_7$ is selected from A, F, H, I, K, L, N, Q, R, S, T, V, W and Y;

$X_{17}$ is selected from F, W and Y;

$X_{18}$ is selected from A, D, E and N;

$X_{21}$ is selected from A, S, V and W;

$X_{25}$ is selected from A, D, E, F, G, H, I, K, L, N, Q, R, S, T, V, W and Y; and $X_{28}$ is selected from A, D, E, F, H, I, K, L, N, Q, R, S, T, V, W and Y.

In another embodiment of the first aspect of the disclosure, said neonatal Fc receptor (FcRn) binding polypeptide comprises an FcRn binding motif, BM, which motif consists of the amino acid sequence (SEQ ID NO: 1075)
EX$_2$ X$_3$ X$_4$ AX$_6$ X$_7$ EIR WLPNLX$_{16}$X$_{17}$ X$_{18}$ QR

X$_{21}$ AFIX$_{25}$ X$_{26}$LX$_{28}$ X$_{29}$ wherein, independently from each other, $X_2$ is selected from A, D, E, F, H, I, K, L, N, Q, R, S, T, V, W and Y;

$X_3$ is selected from A, D, E, F, G, H, I, K, L, M, N, Q, R, S, T, V, W and Y;

$X_4$ is selected from A, D, E, F, G, H, I, K, L, N, Q, R, S, T, V, W and Y;

$X_6$ is selected from A, E, F, G, H, I, K, Q, R, S and V;

$X_7$ is selected from A, F, H, K, N, Q, R, S and V;

$X_{16}$ is selected from N and T;

$X_{17}$ is selected from F, W and Y;

$X_{18}$ is selected from A, D, E and N;

$X_{21}$ is selected from A, S, V and W;

$X_{25}$ is selected from D, E, G, H, I, K, L, N, Q, R, S, T, V, W and Y;

$X_{26}$ is selected from K and S;

$X_{28}$ is selected from A, D, E, F, H, I, K, L, N, Q, R, S, T, V, W and Y; and $X_{29}$ is selected from D and R.

In another embodiment of the first aspect, there is provided an FcRn binding polypeptide, wherein, independently from each other, $X_2$ is selected from A, D, E, F, H, I, K, L, N, Q, R, S, T, V, W and Y;

$X_3$ is selected from A, D, E, F, H, I, K, L, M, N, Q, R, S, T, V, W and Y;

$X_4$ is selected from A, D, E, F, H, I, K, L, N, Q, R, S, T, V, W and Y;

$X_6$ is selected from A, E, F, G, H, I, K, Q, R and S;

$X_7$ is selected from A, F, H, K, N, Q, R, S and V;

$X_{16}$ is selected from N and T;

$X_{17}$ is selected from F and Y;

$X_{18}$ is D;

$X_{21}$ is V;

$X_{25}$ is selected from D, E, H, I, K, L, N, Q, R, S, T, V, W and Y;

$X_{26}$ is selected from K and S;

$X_{28}$ is selected from A, D, E, F, H, I, K, L, N, Q, R, S, T, V and W and.

$X_{29}$ is selected from D and R.

In another embodiment of the first aspect, the BM consists of an amino acid sequence selected from i)
(SEQ ID NO: 1076)
EX$_2$ X$_3$ X$_4$ AX$_6$ HEIR WLPNLTX$_{17}$ X$_{18}$ QR

X$_{21}$ AFIX$_{25}$ KLX$_{28}$ D wherein, independently from each other, $X_2$ is selected from A, D, E, F, H, I, K, L, N, Q, R, S, T, V, W and Y;

$X_3$ is selected from A, D, E, G, H, K, L, M, N, Q, R, S, T, V and Y;

$X_4$ is selected from A, D, E, F, G, I, K, L, N, Q, R, S, T, V and Y;

$X_6$ is selected from A, G, K, R, S and V;

$X_{17}$ is selected from F, W and Y;

$X_{18}$ is selected from A, D, E and N;

$X_{21}$ is selected from A, S, V and W;

$X_{25}$ is selected from D, G, H, K, L, N, R, V and W;

$X_{28}$ is selected from A, D, E, H, K, L, N, Q, R, S, T, W and Y; and ii) an amino acid sequence which has at least 96% identity to said sequence.

In yet another embodiment of said aspect, the BM in sequence i) consists of an amino acid sequence selected from (SEQ ID NO: 1076)
EX$_2$ X$_3$ X$_4$ AX$_6$ HEIR WLPNLTX$_{17}$ X$_{18}$ QR

X$_{21}$ AFIX$_{25}$ KLX$_{28}$ D wherein, independently from each other,
X$_2$ is selected from A, D, E, F, N, Q, R, S and W;
X$_3$ is selected from D, E, G, H, K, M, N, Q, S and T;
X$_4$ is selected from A, D, E, G, N, Q, R, S, T, V and Y;
X$_6$ is selected from A, G, S and V;
X$_{17}$ is selected from F, W and Y;
X$_{18}$ is selected from A, D, E and N;
X$_{21}$ is selected from A, S, V and W;
X$_{25}$ is selected from D, G, H, K, L, N, R and V; and
X$_{28}$ is selected from A, E, H, L, N, Q, R, S, T, W and Y.

As the skilled person will realize, the function of any polypeptide, including the FcRn binding capacity of the polypeptide of the present disclosure, is dependent on the tertiary structure of the polypeptide. It is therefore possible to make minor changes to the sequence of amino acids in a polypeptide without affecting the function thereof. Thus, the disclosure encompasses modified variants of the FcRn binding polypeptide, which are such that the FcRn binding characteristics are retained.

Therefore, as described above, also encompassed by the present disclosure is a FcRn binding polypeptide comprising an amino acid sequence with 96% or greater identity to a polypeptide as defined in i).

In some embodiments, such changes may be made in all positions of the sequences of the FcRn binding polypeptide as disclosed herein. In other embodiments, such changes may be made only in the non-variable positions, also denoted as scaffold amino acid residues. In such cases, changes are not allowed in the variable positions, i.e. positions denoted with an "X" in sequence i). For example, it is possible that an amino acid residue belonging to a certain functional grouping of amino acid residues (e.g. hydrophobic, hydrophilic, polar etc) could be exchanged for another amino acid residue from the same functional group.

The term "% identity", as used throughout the specification, may for example be calculated as follows. The query sequence is aligned to the target sequence using the CLUSTAL W algorithm (Thompson et al. (1994) Nucleic Acids Research 22:4673-4680). A comparison is made over the window corresponding to the shortest of the aligned sequences. The shortest of the aligned sequences may in some instances be the target sequence. In other instances, the query sequence may constitute the shortest of the aligned sequences. The amino acid residues at each position are compared, and the percentage of positions in the query sequence that have identical correspondences in the target sequence is reported as % identity.

Below follows a list of embodiments which further specify amino acid residue X$_n$, wherein n is an integer which denotes the position of said residue within the polypeptide described herein. To clarify, in cases where the BM comprised in the polypeptide may consist of either a given amino acid sequence or an amino acid sequence with at least a given % identity to said given amino acid sequence, the X$_n$ as used herein refers to an amino acid residue in said given amino acid sequence. For example, when applicable, X$_n$ refers to an amino acid residue in sequence i) above.

In one embodiment, X$_2$ is selected from A, D, E, F, I, L, N, Q, R, S, T, V, W and Y.
In one embodiment, X$_2$ is selected from A, D, F, I, L, N, Q, R, S, T, V, W and Y.
In one embodiment, X$_2$ is selected from A, D, F, I, L, N, Q, R, S, V and W.
In one embodiment, X$_2$ is selected from A, I, L, N, Q, R, S, T, V, W and Y.
In one embodiment, X$_2$ is selected from A, I, L, N, Q, S, T, V and W.
In one embodiment, X$_2$ is selected from A, I, L, N, Q, V and W.
In one embodiment, X$_2$ is selected from A, I, L, Q, V and W.
In one embodiment, X$_2$ is selected from A, I, L and Q.
In one embodiment, X$_2$ is selected from I, L and Q.
In one embodiment, X$_2$ is selected from I and Q.
In one embodiment, X$_2$ is I.
In one embodiment, X$_2$ is Q.
In one embodiment, X$_3$ is selected from A, D, E, G, H, K, L, M, N, Q, R, S, T, V and Y.
In one embodiment, X$_3$ is selected from A, D, E, H, K, L, M, N, Q, R, S, T, V and Y.
In one embodiment, X$_3$ is selected from A, D, E, G, H, K, L, M, N, Q, R, S and T.
In one embodiment, X$_3$ is selected from A, D, E, G, H, K, M, N, Q, S and T.
In one embodiment, X$_3$ is selected from A, D, E, G, H, M, N, Q, S and T.
In one embodiment, X$_3$ is selected from A, D, E, K, N, Q, S and T.
In one embodiment, X$_3$ is selected from A, D, E, K, Q, and T.
In one embodiment, X$_3$ is selected from A, D, E, Q and T.
In one embodiment, X$_3$ is selected from D, E and T.
In one embodiment, X$_3$ is selected from D and E.
In one embodiment, X$_3$ is D.
In one embodiment, X$_3$ is E.
In one embodiment, X$_4$ is selected from A, D, E, F, G, I, K, L, N, Q, R, S, T, V and Y.
In one embodiment, X$_4$ is selected from A, D, E, G, N, Q, R, S, T and V.
In one embodiment, X$_4$ is selected from A, D, E, F, I, K, L, N, Q, R, S, T and V.
In one embodiment, X$_4$ is selected from A, D, E, I, K, N, Q, R, S and T.
In one embodiment, X$_4$ is selected from A, D, E, I, K, Q, S and T.
In one embodiment, X$_4$ is selected from A, D, I, K, Q and S.
In one embodiment, X$_4$ is selected from A, D, E, K and S.
In one embodiment, X$_4$ is selected from A, D, K and S.
In one embodiment, X$_4$ is selected from A, D, E and K.
In one embodiment, X$_4$ is selected from A, D and K.
In one embodiment, X$_4$ is selected from A and D.
In one embodiment, X$_4$ is selected from A and E.
In one embodiment, X$_4$ is A.
In one embodiment, X$_4$ is D.
In one embodiment, X$_4$ is E.
In one embodiment, X$_6$ is selected from A, G, K, Q, R, S and V.
In one embodiment, X$_6$ is selected from A, G, K, R, S and V.
In one embodiment, X$_6$ is selected from A, G, K, R and S.
In one embodiment, X$_6$ is selected from A, G, K, S and V.
In one embodiment, X$_6$ is selected from A, G, K and V.
In one embodiment, X$_6$ is selected from A, G, K and S.
In one embodiment, X$_6$ is selected from A, G and K.
In one embodiment, X$_6$ is selected from A, G and V.
In one embodiment, X$_6$ is selected from A and G.

In one embodiment, $X_6$ is A.
In one embodiment, $X_6$ is G.
In one embodiment, $X_7$ is selected from A and H.
In one embodiment, $X_7$ is H.
In one embodiment, $X_{16}$ is T.
In one embodiment, $X_{16}$ is N.
In one embodiment, $X_{17}$ is selected from F and Y.
In one embodiment, $X_{17}$ is F.
In one embodiment, $X_{18}$ is selected from A, D and E.
In one embodiment, $X_{18}$ is selected from A and D.
In one embodiment, $X_{18}$ is D.
In one embodiment, $X_{21}$ is selected from V and W.
In one embodiment, $X_{21}$ is V.
In one embodiment, $X_{25}$ is selected from D, E, G, H, K, L, N, Q, R, V and W.
In one embodiment, $X_{25}$ is selected from D, G, H, K, L, N, R, V and W.
In one embodiment, $X_{25}$ is selected from D, G, H, K, L, N, R and V.
In one embodiment, $X_{25}$ is selected from H, L, R, V and W.
In one embodiment, $X_{25}$ is selected from H, R, V and W.
In one embodiment, $X_{25}$ is selected from H, R and V.
In one embodiment, $X_{25}$ is selected from H, L and R.
In one embodiment, $X_{25}$ is selected from H and R.
In one embodiment, $X_{25}$ is selected from H and V.
In one embodiment, $X_{25}$ is H.
In one embodiment, $X_{26}$ is K.
In one embodiment, $X_{26}$ is S.
In one embodiment, $X_{28}$ is selected from A, D, E, H, K, L, N, Q, R, S, T, W and Y.
In one embodiment, $X_{28}$ is selected from A, D, E, K, L, N, Q, R, S, T, W and Y.
In one embodiment, $X_{28}$ is selected from A, D, E, L, R, S, T, W and Y.
In one embodiment, $X_{28}$ is selected from A, D, K, L, N, Q, R, S, T and W.
In one embodiment, $X_{28}$ is selected from A, D and R.
In one embodiment, $X_{28}$ is selected from A and R.
In one embodiment, $X_{28}$ is selected from D and R.
In one embodiment, $X_{28}$ is A.
In one embodiment, $X_{28}$ is R.
In one embodiment, $X_{29}$ is D.
In one embodiment, $X_{29}$ is R.
In one embodiment, $X_6X_7$ is selected from AH and GH.
In one embodiment, $X_6X_7$ is AH.
In one embodiment, $X_6X_7$ is GH.
In one embodiment, $X_{17}X_{18}$ is selected from FD and YD.
In one embodiment, $X_{17}X_{18}$ is FD.

In a more specific embodiment defining a sub-class of the FcRn binding polypeptide, the sequence fulfills at least three of the six conditions I-VI:

I. $X_6$ is selected from A, G, K and S, such as in particular A;
II. $X_7$ is H;
III. $X_{17}$ is selected from F and Y, such as in particular F;
IV. $X_{18}$ is D;
V. $X_{21}$ is selected from V and W, such as in particular V;
VI. $X_{25}$ is selected from H and R, such as in particular H.

In some examples of an FcRn binding polypeptide according to the first aspect, said sequence fulfills at least four of the six conditions I-VI. More specifically, the sequence may fulfill at least five of the six conditions I-VI, such as all of the six conditions I-VI.

As described in detail in the experimental section to follow, the selection of FcRn binding polypeptide variants has led to the identification of a number of individual FcRn binding motif (BM) sequences. These sequences constitute individual embodiments according to this aspect. The sequences of individual FcRn binding motifs are presented in FIG. 1 and as SEQ ID NO:1-353. Hence, in one embodiment of the FcRn binding polypeptide according to this aspect, the sequence is selected from the group consisting of SEQ ID NO:1-353. In one embodiment, the sequence is selected from the group consisting of SEQ ID NO:1-15, SEQ ID NO:17-140 and SEQ ID NO:353. In one embodiment, the sequence is selected from the group consisting of SEQ ID NO:1-2 and SEQ ID NO:17-140. In one embodiment, the sequence is selected from the group consisting of SEQ ID NO:1-2, SEQ ID NO:17-92, SEQ ID NO:94-103, SEQ ID NO:105-125 and SEQ ID NO:127-140. In one embodiment, the sequence is selected from the group consisting of SEQ ID NO:1-8, SEQ ID NO:13 SEQ ID NO:19-20, SEQ ID NO:23, SEQ ID NO:28, SEQ ID NO:41, SEQ ID NO:44, SEQ ID NO:65, SEQ ID NO:70, SEQ ID NO:73, SEQ ID NO:75-77 and SEQ ID NO:353. In another embodiment, the sequence is selected from the group consisting of SEQ ID NO:1, SEQ ID NO:23, SEQ ID NO:28, SEQ ID NO:41, SEQ ID NO:44, SEQ ID NO:65, SEQ ID NO:73 and SEQ ID NO:75-77. In yet another embodiment, the sequence is selected from SEQ ID NO:1, SEQ ID NO:23, SEQ ID NO:44, SEQ ID NO:65, SEQ ID NO:75 and SEQ ID NO:77. In one embodiment, the sequence is selected from SEQ ID NO:1, SEQ ID NO:23 and SEQ ID NO:75. In one embodiment, the sequence is SEQ ID NO:1.

In some embodiments of the present disclosure, the BM as defined above "forms part of" a three-helix bundle protein domain. This is understood to mean that the sequence of the BM is "inserted" into or "grafted" onto the sequence of the original three-helix bundle domain, such that the BM replaces a similar structural motif in the original domain. For example, without wishing to be bound by theory, the BM is thought to constitute two of the three helices of a three-helix bundle, and can therefore replace such a two-helix motif within any three-helix bundle. As the skilled person will realize, the replacement of two helices of the three-helix bundle domain by the two BM helices has to be performed so as not to affect the basic structure of the polypeptide. That is, the overall folding of the Cα backbone of the polypeptide according to this embodiment of the invention is substantially the same as that of the three-helix bundle protein domain of which it forms a part, e.g. having the same elements of secondary structure in the same order etc. Thus, a BM according to the disclosure "forms part" of a three-helix bundle domain if the polypeptide according to this embodiment of the aspect has the same fold as the original domain, implying that the basic structural properties are shared, those properties e.g. resulting in similar CD spectra. The skilled person is aware of other parameters that are relevant.

In particular embodiments, the FcRn binding motif (BM) thus forms part of a three-helix bundle protein domain. For example, the BM may essentially constitute two alpha helices with an interconnecting loop, within said three-helix bundle protein domain. In particular embodiments, said three-helix bundle protein domain is selected from domains of bacterial receptor proteins. Non-limiting examples of such domains are the five different three-helical domains of Protein A from *Staphylococcus aureus*, such as domain B, and derivatives thereof. In some embodiments, the three-helical bundle protein domain is a variant of protein Z, which is derived from domain B of staphylococcal Protein A.

In embodiments where the FcRn binding polypeptide of the invention forms part of a three-helix bundle protein domain, the FcRn binding polypeptide may comprise an amino acid sequence selected from:

iii)
(SEQ ID NO: 1077)
K-[BM]-DPSQS $X_aX_b$LLX$_c$ EAKKL $X_dX_eX_fQ$;

wherein
[BM] is an FcRn binding motif as defined herein, provided that $X_{29}$ is D;
$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S; and iv) an amino acid sequence which has at least 93% identity to a sequence defined by iii).

In embodiments where the FcRn binding polypeptide of the invention forms part of a three-helix bundle protein domain, the FcRn binding polypeptide may comprise an amino acid sequence selected from:

v)
(SEQ ID NO: 1080)
K-[BM]-QPEQS $X_aX_b$LLX$_c$ EAKKL $X_dX_eX_fQ$;

wherein
[BM] is an FcRn binding motif as defined herein, provided that $X_{29}$ is R;
$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S; and vi) an amino acid sequence which has at least 93% identity to a sequence defined by v).

As discussed above, polypeptides comprising minor changes as compared to the above amino acid sequences which do not largely affect the tertiary structure and the function thereof are also within the scope of the present disclosure. Thus, in some embodiments, sequence iv) or sequence vi) has at least 95%, for example at least 97% identity to a sequence defined by iii) and v), respectively.

In one embodiment, $X_a$ in sequence iii) or v) is A. In an alternative embodiment, $X_a$ in sequence iii) or v) is S.

In one embodiment, $X_b$ in sequence iii) or v) is N. In an alternative embodiment, $X_b$ in sequence iii) or v) is E.

In one embodiment, $X_c$ in sequence iii) or v) is A. In an alternative embodiment, $X_c$ in sequence iii) or v) is S. In yet another alternative embodiment, $X_c$ in sequence iii) or v) is C.

In one embodiment, $X_d$ in sequence iii) or v) is E.
In one embodiment, $X_d$ in sequence iii) or v) is N.
In one embodiment, $X_d$ in sequence iii) or v) is S.
In one embodiment, $X_e$ in sequence iii) or v) is D.
In one embodiment, $X_e$ in sequence iii) or v) is E.
In one embodiment, $X_e$ in sequence iii) or v) is S.
In one embodiment, $X_dX_e$ in sequence iii) or v) is selected from EE, ES, SE and SS.
In one embodiment, $X_dX_e$ in sequence iii) or v) is ES.
In one embodiment, $X_dX_e$ in sequence iii) or v) is SE.
In one embodiment, $X_f$ in sequence iii) or v) is A. In an alternative embodiment, $X_f$ in sequence iii) or v) is S.
In one embodiment, in sequence iii) or v), $X_a$ is A; $X_b$ is N; $X_c$ is A and $X_f$ is A.
In one embodiment, in sequence iii) or v), $X_a$ is A; $X_b$ is N; $X_c$ is C and $X_f$ is A.
In one embodiment, in sequence iii) or v), $X_a$ is S; $X_b$ is E; $X_c$ is S and $X_f$ is S.
In one embodiment, in sequence iii) or v), $X_a$ is S; $X_b$ is E; $X_c$ is C and $X_f$ is S.
In one embodiment, in sequence iii) or v), $X_a$ is A; $X_b$ is N; $X_c$ is A; $X_dX_e$ is ND and $X_f$ is A.
In one embodiment, in sequence iii) or v), $X_a$ is A; $X_b$ is N; $X_c$ is C; $X_dX_e$ is ND and $X_f$ is A.
In one embodiment, in sequence iii) or v), $X_a$ is S; $X_b$ is E; $X_c$ is S; $X_dX_e$ is ND and $X_f$ is S.
In one embodiment, in sequence iii) or v), $X_a$ is S; $X_b$ is E; $X_c$ is C; $X_dX_e$ is ND and $X_f$ is S.
In one embodiment, in sequence iii) or v), $X_a$ is A; $X_b$ is N; $X_c$ is A; $X_dX_e$ is SE and $X_f$ is A.
In one embodiment, in sequence iii) or v), $X_a$ is A; $X_b$ is N; $X_c$ is C; $X_dX_e$ is SE and $X_f$ is A.
In one embodiment, in sequence iii) or v), $X_a$ is S; $X_b$ is E; $X_c$ is S; $X_dX_e$ is SE and $X_f$ is S.
In one embodiment, in sequence iii) or v), $X_a$ is S; $X_b$ is E; $X_c$ is C; $X_dX_e$ is SE and $X_f$ is S.
In one embodiment, in sequence iii) or v), $X_a$ is A; $X_b$ is N; $X_c$ is A; $X_dX_e$ is ES and $X_f$ is A.
In one embodiment, in sequence iii) or v), $X_a$ is A; $X_b$ is N; $X_c$ is C; $X_dX_e$ is ES and $X_f$ is A.
In one embodiment, in sequence iii) or v), $X_a$ is S; $X_b$ is E; $X_c$ is S; $X_dX_e$ is ES and $X_f$ is S.
In one embodiment, in sequence iii) or v), $X_a$ is S; $X_b$ is E; $X_c$ is C; $X_dX_e$ is ES and $X_f$ is S.

In yet a further embodiment, sequence iii) in the definition of FcRn binding polypeptides above is selected from the group consisting of SEQ ID NO:354-706. In one embodiment, sequence iii) is selected from the group consisting of SEQ ID NO:354-368, SEQ ID NO:370-493 and SEQ ID NO:706. In one embodiment, sequence iii) is selected from the group consisting of SEQ ID NO:354-355 and SEQ ID NO:370-493. In one embodiment, sequence iii) is selected from the group consisting of SEQ ID NO:354-355, SEQ ID NO:370-445, SEQ ID NO:447-456, SEQ ID NO:458-478 and SEQ ID NO:480-493. In one embodiment, sequence iii) is selected from the group consisting of SEQ ID NO:354-361, SEQ ID NO:366, SEQ ID NO:372-373, SEQ ID NO:376, SEQ ID NO:381, SEQ ID NO:394, SEQ ID NO:397, SEQ ID NO:418, SEQ ID NO:423, SEQ ID NO:426, SEQ ID NO:428-430 and SEQ ID NO:706. In another embodiment, sequence iii) is selected from the group consisting of SEQ ID NO:354, SEQ ID NO:376, SEQ ID NO:381, SEQ ID NO:394, SEQ ID NO:397, SEQ ID NO:418, SEQ ID NO:426 and SEQ ID NO:428-430. In yet another embodiment, sequence iii) is selected from SEQ ID NO:354, SEQ ID NO:376, SEQ ID NO:397, SEQ ID NO:418, SEQ ID NO:428 and SEQ ID NO:430. In one embodiment, sequence iii) is selected from SEQ ID NO:354, SEQ ID NO:376 and SEQ ID NO:428. In one embodiment, sequence iii) is SEQ ID NO:354.

Also, in a further embodiment, there is provided an FcRn binding polypeptide as defined above, which comprises an amino acid sequence selected from:

(SEQ ID NO: 1081)
vii) YAK-[BM]-DPSQS SELLX$_c$ EAKKL NDSQA P;

wherein [BM] is an FcRn binding motif as defined above and $X_c$ is selected from A, S and C; and viii) an amino acid sequence which has at least 94% identity to a sequence defined by vii).

Alternatively, there is provided an FcRn binding polypeptide as defined above, which comprises an amino acid sequence selected from:

(SEQ ID NO: 1082)
ix) FNK-[BM]-DPSQS ANLLX$_c$ EAKKL NDAQA P;

wherein [BM] is an FcRn binding motif as defined above and X$_c$ is selected from A and C; and x) an amino acid sequence which has at least 94% identity to a sequence defined by ix).

As discussed above, polypeptides comprising minor changes as compared to the above amino acid sequences that do not largely affect the tertiary structure and the function thereof are also within the scope of the present disclosure. Thus, in some embodiments, the FcRn binding polypeptide as defined above may comprise a sequence which is at least 96%, such as at least 98% identical to a sequence defined by vii) or ix).

In some embodiments, the FcRn binding motif may form part of a polypeptide comprising an amino acid sequence selected from (SEQ ID NO: 1083)
ADNNFNK-[BM]-DPSQSANLLSEAKKLNESQAPK;

(SEQ ID NO: 1084)
ADNKFNK-[BM]-DPSQSANLLAEAKKLNDAQAPK;

(SEQ ID NO: 1085)
ADNKFNK-[BM]-DPSVSKEILAEAKKLNDAQAPK;

(SEQ ID NO: 1086)
ADAQQNNFNK-[BM]-DPSQSTNVLGEAKKLNESQAPK;

(SEQ ID NO: 1087)
AQHDE-[BM]-DPSQSANVLGEAQKLNDSQAPK;

(SEQ ID NO: 1088)
VDNKFNK-[BM]-DPSQSANLLAEAKKLNDAQAPK;

(SEQ ID NO: 1089)
AEAKYAK-[BM]-DPSESSELLSEAKKLNKSQAPK;

(SEQ ID NO: 1090)
VDAKYAK-[BM]-DPSQSSELLAEAKKLNDAQAPK;

(SEQ ID NO: 1091)
VDAKYAK-[BM]-DPSQSSELLAEAKKLNDSQAPK;

(SEQ ID NO: 1092)
AEAKYAK-[BM]-DPSQSSELLSEAKKLNDSQAPK;

(SEQ ID NO: 1093)
AEAKYAK-[BM]-DPSQSSELLSEAKKLSESQAPK;

(SEQ ID NO: 1094)
AEAKYAK-[BM]-DPSQSSELLSEAKKLESSQAPK;

(SEQ ID NO: 1095)
VDAKYAK-[BM]-DPSQSSELLSEAKKLNDSQAPK;

(SEQ ID NO: 1096)
VDAKYAK-[BM]-DPSQSSELLSEAKKLSESQAPK;

(SEQ ID NO: 1097)
VDAKYAK-[BM]-DPSQSSELLSEAKKLESSQAPK;

(SEQ ID NO: 1098)
VDAKYAK-[BM]-DPSQSSELLAEAKKLNKAQAPK;
and (SEQ ID NO: 1099)
AEAKYAK-[BM]-DPSQSSELLAEAKKLNKAQAPK;

wherein [BM] is an FcRn binding motif as defined above.

In one embodiment, the FcRn binding polypeptide comprises an amino acid sequence selected from:

xi)
(SEQ ID NO: 1078)
AEAKYAK-[BM]-DPSQSSELLSEAKKLNDSQAPK;

wherein [BM] is an FcRn binding motif as defined above; and xii) an amino acid sequence which has at least 94% identity to the sequence defined in xi).

In one embodiment, sequence xi) is selected from the group consisting of SEQ ID NO:1060-1062.

In one embodiment, the FcRn binding polypeptide comprises an amino acid sequence selected from:

xiii)
(SEQ ID NO: 1079)
VDAKYAK-[BM]-DPSQSSELLSEAKKLNDSQAPK;

wherein [BM] is an FcRn binding motif as defined above; and xiv) an amino acid sequence which has at least 94% identity to the sequence defined in xiii).

Sequence xiii) in such a polypeptide may for example be selected from the group consisting of SEQ ID NO:707-1059. In one embodiment, sequence xiii) is selected from the group consisting of SEQ ID NO:707-721, SEQ ID NO:723-846 and SEQ ID NO:1059. In one embodiment, sequence xiii) is selected from the group consisting of SEQ ID NO:707-708 and SEQ ID NO:723-846. In one embodiment, sequence xiii) is selected from the group consisting of SEQ ID NO:707-708, SEQ ID NO:723-798, SEQ ID NO:800-809, SEQ ID NO:811-831 and SEQ ID NO:833-846. In one embodiment, sequence xiii) is selected from the group consisting of SEQ ID NO:707-714, SEQ ID NO:719, SEQ ID NO:725-726, SEQ ID NO:729, SEQ ID NO:734, SEQ ID NO:747, SEQ ID NO:750, SEQ ID NO:771, SEQ ID NO:776, SEQ ID NO:779, SEQ ID NO:781-783 and SEQ ID NO:1059. In another embodiment, sequence xiii) is selected from the group consisting of SEQ ID NO:707, SEQ ID NO:729, SEQ ID NO:734, SEQ ID NO:747, SEQ ID NO:750, SEQ ID NO:771, SEQ ID NO:779 and SEQ ID NO:781-783. In yet another embodiment, sequence xiii) is selected from SEQ ID NO:707, SEQ ID NO:729, SEQ ID NO:750, SEQ ID NO:771, SEQ ID NO:781 and SEQ ID NO:783. In one embodiment, sequence xiii) is selected from SEQ ID NO:707, SEQ ID NO:729 and SEQ ID NO:781. In one embodiment, sequence xiii) is SEQ ID NO:707.

Again, polypeptides comprising minor changes as compared to the above amino acid sequences which do not largely affect the tertiary structure and the function thereof are also within the scope of the present disclosure. Thus, in some embodiments, the FcRn binding polypeptide as defined above may comprise a sequence which is at least 96%, such as at least 98% identical to a sequence defined by xi) or xiii).

The terms "FcRn binding" and "binding affinity for FcRn" as used in this specification refer to a property of a polypeptide which may be tested for example by the use of surface plasmon resonance (SPR) technology or ELISA.

For example as described in the examples below, FcRn binding affinity may be tested in an experiment in which FcRn, or a correctly folded fragment thereof, is immobilized on a sensor chip of the instrument, and the sample containing the polypeptide to be tested is passed over the chip. Alternatively, the polypeptide to be tested is immobilized on a sensor chip of the instrument, and a sample containing FcRn, or a correctly folded fragment thereof, is passed over the chip. The skilled person may then interpret the results obtained by such experiments to establish at least a qualitative measure of the binding affinity of the polypeptide for FcRn. If a quantitative measure is desired, for example to determine a $K_D$ value for the interaction, surface plasmon resonance methods may also be used. Binding values may for example be defined in a Biacore (GE Healthcare) or ProteOn XPR 36 (Bio-Rad) instrument. FcRn is suitably immobilized on a sensor chip of the instrument, and samples of the polypeptide whose affinity is to be determined are prepared by serial dilution and injected in random order. $K_D$ values may then be calculated from the results using for example the 1:1 Langmuir binding model of the BIAevaluation 4.1 software, or other suitable software, provided by the instrument manufacturer.

Alternatively, as described in the examples below, FcRn binding affinity may be tested in an experiment in which samples of the polypeptide are captured on antibody coated ELISA plates, and biotinylated FcRn is added followed by streptavidin conjugated HRP. TMB substrate is added and the absorbance at 450 nm is measured using a multi-well plate reader, such as Victor$^3$ (Perkin Elmer). The skilled person may then interpret the results obtained by such experiments to establish at least a qualitative measure of the binding affinity of the polypeptide for FcRn. If a quantitative measure is desired, for example to determine the $K_D$ value (the half maximal effective concentration) for the interaction, ELISA may also be used. The response of the polypeptides against a dilution series of biotinylated FcRn are measured using ELISA as described above. The skilled person may then interpret the results obtained by such experiments and $K_D$ values may be calculated from the results using for example GraphPad Prism 5 and non-linear regression.

In one embodiment, there is provided an FcRn binding polypeptide, which is capable of binding to FcRn at pH 6.0 such that the $K_D$ value of the interaction is at most $1\times10^{-6}$ M, such as at most $1\times10^{-7}$ M, such as at most $1\times10^{-8}$ M, such as at most $1\times10^{-9}$ M, such as at most $1\times10^{-10}$ M. An FcRn binding polypeptide according to this embodiment would bind, or remain bound, to FcRn in acidic pH conditions, such as pH 6.0, for example in a lysosome. If such a polypeptide were to enter an increasingly acidic intracellular environment, it would be recycled to the plasma membrane through its interaction with FcRn, and thus avoid degradation.

In one embodiment, the $K_D$ value of the interaction between FcRn binding polypeptide and FcRn at pH 7.4 is higher than the $K_D$ value of said interaction at pH 6.0. Thus, the FcRn binding polypeptide would bind to FcRn with higher affinity at pH 6.0 than at pH 7.4. In one embodiment, the $K_D$ value of said interaction at pH 7.4 is at least 2 times higher, such as at least 5 times higher, such as at least 10 times higher, such as at least 50 times higher, such as at least 100 times higher than the $K_D$ value of said interaction at pH 6.0.

In one embodiment, the $K_D$ value of the interaction between FcRn binding polypeptide and FcRn at pH 7.4 is at least $1\times10^{-8}$ M, such as at least $1\times10^{-7}$ M, such as at least $1\times10^{-6}$ M, such as at least $1\times10^{-5}$ M. In some embodiments, the only criterion for the interaction between FcRn binding polypeptide and FcRn at pH 7.4 is that any FcRn binding polypeptide which has bound to FcRn during more acidic conditions is released more rapidly from FcRn when the pH value increases.

In an alternative embodiment, there is provided an FcRn binding polypeptide, for which the $K_D$ of said interaction at pH 7.4 is the same as or lower than the $K_D$ of said interaction at pH 6.0. An FcRn binding polypeptide according to this embodiment would bind or remain bound to FcRn in acidic pH conditions (i.e. would have an off-rate at pH 6.0 which is sufficiently slow to avoid release), for example in the lysosome, as well as in neutral or slightly basic pH conditions, for example on the plasma membrane. In a more specific embodiment, the $K_D$ value of said interaction at pH 7.4 is at least 2 times lower, such as at least 5 times lower, such as at least 10 times lower, such as at least 50 times lower, such as at least 100 times lower than the $K_D$ value of said interaction at pH 6.0.

In another embodiment, there is provided an FcRn binding polypeptide, which is capable of binding to FcRn at pH 7.4 such that the $K_D$ value of the interaction is at most $1\times10^{-6}$ M, such as at most $1\times10^{-7}$ M, such as at most $1\times10^{-8}$ M, such as at most $1\times10^{-9}$ M, such as at most $1\times10^{-10}$ M. An FcRn binding polypeptide according to this embodiment would bind or remain bound for an extended time to FcRn in neutral or slightly basic pH conditions, such as pH 7.4, for example on the plasma membrane. The term "remain bound" should be understood to mean an interaction having a slow off-rate at given conditions.

In general, the skilled person knows that the $K_D$ value of an interaction is defined as the ratio between the off-rate ($k_{off}$) and the on-rate ($k_{on}$). Thus, a high $K_D$ value may be due to either a high $k_{off}$, a low $k_{on}$ or both, and conversely, a low $K_D$ value may be due to either a low $k_{off}$, a high $k_{on}$ or both.

The skilled person will understand that various modifications and/or additions can be made to an FcRn binding polypeptide according to any aspect disclosed herein in order to tailor the polypeptide to a specific application without departing from the scope of the present disclosure.

For example, in one embodiment there is provided an FcRn binding polypeptide as described herein, which polypeptide has been extended by one or more amino acids at the C terminal and/or N terminal end. Such a polypeptide should be understood as a polypeptide having one or more additional amino acid residues at the very first and/or the very last position in the polypeptide chain. Thus, an FcRn binding polypeptide may comprise any suitable number of additional amino acid residues, for example at least one additional amino acid residue. Each additional amino acid residue may individually or collectively be added in order to, for example, improve production, purification, stabilization in vivo or in vitro, coupling, or detection of the polypeptide. Such additional amino acid residues may comprise one or more amino acid residues added for the purpose of chemical coupling. One example of this is the addition of a cysteine residue. Such additional amino acid residues may also provide a "tag" for purification or detection of the polypeptide, such as a His$_6$ tag or a "myc" (c-myc) tag or a "FLAG" tag for interaction with antibodies specific to the tag or immobilized metal affinity chromatography (IMAC) in the case of the hexahistidine tag.

The further amino acids as discussed above may be coupled to the FcRn binding polypeptide by means of chemical conjugation (using known organic chemistry methods) or by any other means, such as expression of the FcRn binding polypeptide as a fusion protein or joined in any other fashion, either directly or via a linker, for example an amino acid linker.

The further amino acids as discussed above may for example comprise one or more polypeptide domain(s). A further polypeptide domain may provide the FcRn binding polypeptide with another function, such as for example another binding function, or an enzymatic function, or a toxic function or a fluorescent signaling function, or combinations thereof.

A further polypeptide domain may moreover provide another FcRn binding moiety with the same FcRn binding function. Thus, in a further embodiment, there is provided an FcRn binding polypeptide in a multimeric form. Said multimer is understood to comprise at least two FcRn binding polypeptides as disclosed herein as monomer units, the amino acid sequences of which may be the same or different. Multimeric forms of the polypeptides may comprise a suitable number of domains, each having an FcRn binding motif, and each forming a monomer within the multimer. These domains may have the same amino acid sequence, but alternatively, they may have different amino acid sequences. In other words, the FcRn binding polypeptide of the invention may form homo- or heteromultimers, for example homo- or heterodimers. In one embodiment, there is provided an FcRn binding polypeptide, wherein said monomeric units are covalently coupled together. In another embodiment, said FcRn binding polypeptide monomer units are expressed as a fusion protein. In one embodiment, there is provided an FcRn binding polypeptide in dimeric form.

Additionally, "heterogenic" fusion polypeptides or proteins, or conjugates, in which an FcRn binding polypeptide described herein, or multimer thereof, constitutes a first domain, or first moiety, and the second and further moieties have other functions than binding FcRn, are also contemplated and fall within the ambit of the present disclosure. The second and further moiety/moieties of the fusion polypeptide or conjugate in such a protein suitably have a desired biological activity.

Thus, in a second aspect of the present disclosure, there is provided a fusion protein or a conjugate, comprising a first moiety consisting of an FcRn binding polypeptide according to the first aspect, and a second moiety consisting of a polypeptide having a desired biological activity. In another embodiment, said fusion protein or conjugate may additionally comprise further moieties, comprising desired biological activities that can be either the same or different from the biological activity of the second moiety.

Such heterogenic fusion polypeptides could also be used to create heteromultimeric complexes of higher order. One example is a heterodimeric complex of two fusion polypeptides, each comprising an FcRn binding polypeptide according to the present disclosure in fusion with another moiety. Such a complex could for example form a heterodimer in vivo or in vitro and be held together by non-covalent and/or covalent interactions. A specific example of such a complex is a Fab fragment, in which both the light chain and heavy chain are produced in fusion with one FcRn binding polypeptide each, and which may include an inter-domain disulphide bond. Many biologically relevant, heterodimeric complexes known to the skilled person may be constructed using FcRn binding fusion proteins as monomer units.

In one embodiment of said fusion protein or conjugate, the total size of the molecule is below the threshold for efficient renal clearance upon administration to a mammalian subject.

In another embodiment of said fusion protein or conjugate, the total size of the molecule is above the threshold for efficient renal clearance upon administration to a mammalian subject.

In one embodiment, there is provided a fusion protein or conjugate, wherein the in vivo half-life of said fusion protein or conjugate is longer than the in vivo half-life of the polypeptide having the desired biological activity per se.

Non-limiting examples of a desired biological activity comprise a therapeutic activity, a binding activity, and an enzymatic activity.

In one embodiment, said desired biological activity is a binding activity to a selected target.

One example of such a binding activity is a binding activity, which increases the in vivo half-life of a fusion protein or conjugate. This fusion protein or conjugate may comprise at least one further moiety. In one particular embodiment, said target is albumin, binding to which increases the in vivo half-life of said fusion protein or conjugate. In one embodiment, said albumin binding activity is provided by an albumin binding domain (ABD) of streptococcal protein G or a derivative thereof. For example, said fusion protein or conjugate, comprising at least one further moiety, may comprise [FcRn binding polypeptide moiety]-[albumin binding moiety]-[moiety with affinity for selected target]. It is to be understood that the three moieties in this example may be arranged in any order from the N- to the C-terminal of the polypeptide.

In one embodiment, when a complex between a target and the fusion protein or conjugate as described herein is formed (or maintained) at acidic pH, such as pH 6.0, the target is rescued from elimination by lysosomal degradation. Thus, target half-life is extended. Half-life extension implies that the elimination rate of a target is lower when interacting with said fusion protein or conjugate than the elimination rate of the target molecule in the absence of said fusion protein or conjugate. Furthermore, it is desirable in this embodiment that the binding of target by the fusion protein or conjugate should not interfere substantially with the function of the target.

On the other hand, when a complex between the target and the fusion protein or conjugate as described herein is not maintained or not formed at acidic pH, the target is directed to the subcellular lysosomes where it is degraded.

In one embodiment, there is provided a fusion protein or conjugate, wherein the rate of elimination of a selected, undesirable target from the subject is increased. Increased elimination of an undesirable target implies increased elimination rate of the target from the body of the multicellular organism, as compared to a "normal" elimination rate of the target molecule per se, i.e. without previous interaction with the fusion protein or conjugate.

In another embodiment, binding of a selected undesirable target could inactivate the function of the target, thereby blocking its biological activity in situations where this is desirable. Such biological activity may for example be activation or blocking of receptors or an enzymatic or otherwise toxic or undesirable activity. Such undesirable target may be an endogenous hormone, enzyme, cytokine, chemokine or a target having some other biological activity. By using an inactivating target binding, the biological activity is blocked until the target is delivered for degradation and released at a low pH value, and the target binding fusion protein is recycled to circulation. This recycling of the target binding fusion protein (via its FcRn binding moiety) enables it to "catalyze" the removal of more than one molecule of the selected undesirable target.

Undesirable targets may for example be foreign proteins and compounds, or naturally expressed proteins that display elevated levels in plasma following a medical condition and where a therapeutic effect may be achieved by elimination of said protein. The undesired target is not necessarily evenly distributed in the plasma but may be concentrated in certain regions, for example around a tumor or at sites of inflammation.

Non-limiting examples of targets are targets selected from the group consisting of allergens, amyloids, antibodies, auto-antigens, blood clotting factors, hormones, tumor cells, drug molecules, cytokines, chemokines, proteases, hypersensitivity mediators, proinflammatory factors, toxins such as bacterial toxins and snake venoms; pollutants, metals and anti-oxidants.

Under certain conditions, such as in certain cancer diseases, it is desired to remove endogenous molecules, for example VEGF, PDGF, HGF and other growth stimulatory hormones. Such molecules could also be targeted by a binding function in said fusion protein or conjugate.

Under other conditions, such as in certain immunological diseases, it may be desirable to remove endogenous molecules transiently, such as selected interleukines or TNF. Such molecules could also be targeted by a binding function in said fusion protein or conjugate.

In one embodiment, the second moiety having a desired biological activity is a therapeutically active polypeptide. Non-limiting examples of therapeutically active polypeptides are biomolecules, such as molecules selected from the group consisting of enzymes, for example algasidase α and β, glucocerebrosidase, laronidase, arylsulphatase, aglucosidase-α, asparaginase, Factor VII, Factor VIII, Factor IX and Factor Xa; hormones and growth factors, for example growth hormone, transforming growth factor-β2, erythropoietin, insulin, insulin-like growth factor-1, myostatin, bone-derived growth factor and glucagon-like peptide-1; chemokines, for example CCL17, CCL19, CCL20, CCL21, CCL22, CCL27, XCL1 and CXC3CL1; and cytokines, for example interleukin (IL)-2, IL-4, IL-7, IL-10, IL-12, IL-15, IL-18, IL-22, IL-27, interferon (IFN)-α, IFN-β, IFN-γ, tumor necrosis factor, granulocyte-colony stimulating factor (G-CSF), macrophage-CSF, and granulocyte/macrophage-CSF.

As the skilled person understands, the FcRn binding polypeptide according to the first aspect may be useful in a fusion protein or as a conjugate partner to any other moiety. Therefore, the above lists of therapeutically active polypeptides should not be construed as limiting in any way.

Other possibilities for the creation of fusion polypeptides or conjugates are also contemplated. Thus, an FcRn binding polypeptide according to the first aspect of the invention may be covalently coupled to a second or further moiety or moieties, which in addition to or instead of target binding exhibit other functions. One example is a fusion between one or more FcRn binding polypeptide(s) and an enzymatically active polypeptide serving as a reporter or effector moiety.

With regard to the description above of fusion proteins or conjugates incorporating an FcRn binding polypeptide according to the disclosure, it is to be noted that the designation of first, second and further moieties is made for clarity reasons to distinguish between FcRn binding polypeptide or polypeptides according to the disclosure on the one hand, and moieties exhibiting other functions on the other hand. These designations are not intended to refer to the actual order of the different domains in the polypeptide chain of the fusion protein or conjugate. Thus, for example, said first moiety may without restriction appear at the N-terminal end, in the middle, or at the C-terminal end of the fusion protein or conjugate.

In one embodiment, there is provided an FcRn binding polypeptide, fusion protein or conjugate, which binds to FcRn such that binding of IgG to FcRn is at least partially inhibited. This inhibition may be due to binding of the FcRn binding polypeptide, fusion protein or conjugate to the same, or an at least partially overlapping, region of FcRn as IgG. Alternatively, the FcRn binding polypeptide, fusion protein or conjugate may bind to a different region of FcRn than IgG but sterically hinder the binding of IgG to FcRn. Thus, the rate of elimination or clearance of IgG from the circulatory system would increase due to increased lysosomal degradation of IgG, because the FcRn mediated recycling of IgG would be wholly or partially unavailable due to the occupation of FcRn binding sites by the FcRn binding polypeptide according to the present disclosure. In other words, administration of FcRn binding polypeptide, fusion protein or conjugate or composition according to the present disclosure will act to increase the catabolism of circulating IgG antibodies.

In one embodiment, the $K_D$ value of the interaction between the FcRn binding polypeptide, fusion protein or conjugate and FcRn is lower than the $K_D$ of the interaction between IgG and FcRn. This relationship may be true at both pH 6.0 and pH 7.4, or at pH 6.0 only.

The above aspects furthermore encompass polypeptides in which the FcRn binding polypeptide according to the first aspect, or the FcRn binding polypeptide as comprised in a fusion protein or conjugate according to the second aspect, further comprises a label, such as a label selected from the group consisting of fluorescent dyes and metals, chromophoric dyes, chemiluminescent compounds and bioluminescent proteins, enzymes, radionuclides and particles. Such labels may for example be used for detection of the polypeptide.

In other embodiments, the labeled FcRn binding polypeptide is present as a moiety in a fusion protein or conjugate also comprising a second moiety having a desired biological activity and/or comprising a binding function as described above. The label may in some instances be coupled only to the FcRn binding polypeptide, and in some instances both to the FcRn binding polypeptide and to the second moiety of the conjugate or fusion protein. Furthermore, it is also possible that the label may be coupled to a second moiety only and not to the FcRn binding moiety. Hence, in yet another embodiment there is provided an FcRn binding polypeptide comprising a second moiety, wherein said label is coupled to the second moiety only.

When reference is made to a labeled polypeptide, this should be understood as a reference to all aspects of polypeptides as described herein, including fusion proteins and conjugates comprising an FcRn binding polypeptide and a second and optionally further moieties. Thus, a labeled polypeptide may contain only the FcRn binding polypeptide and e.g. a therapeutic radionuclide, which may be chelated or covalently coupled to the FcRn binding polypeptide, or contain the FcRn binding polypeptide, a therapeutic radionuclide and a second moiety such as a small molecule having a desired biological activity, for example resulting in a therapeutic efficacy.

In embodiments where the FcRn binding polypeptide, fusion protein or conjugate is radiolabeled, such a radiolabeled polypeptide may comprise a radionuclide. A majority of radionuclides have a metallic nature, are used in the ionic form, and are typically incapable of forming stable covalent bonds with elements presented in proteins and peptides. For this reason, labeling of proteins and peptides with radioactive metals is performed with the use of chelators, i.e. multidentate ligands, which form non-covalent compounds, called chelates, with the metal ions. In an embodiment of the FcRn binding polypeptide, fusion protein or conjugate, the incorporation of a radionuclide is enabled through the provision of a chelating environment, through which the radionuclide may be coordinated, chelated or complexed to the polypeptide.

One example of a chelator is the polyaminopolycarboxylate type of chelator. Two classes of such polyaminopolycarboxylate chelators can be distinguished: macrocyclic and acyclic chelators.

In one embodiment, the FcRn binding polypeptide, fusion protein or conjugate comprises a chelating environment provided by a polyaminopolycarboxylate chelator conjugated to the FcRn binding polypeptide via a thiol group of a cysteine residue or an epsilon amine group of a lysine residue.

The most commonly used macrocyclic chelators for radioisotopes of indium, gallium, yttrium, bismuth, radioactinides and radiolanthanides are different derivatives of DOTA (1,4,7,10-tetraazacyclododecane-1,4,7,10-tetraacetic acid). In one embodiment, a chelating environment of the FcRn binding polypeptide, fusion protein or conjugate is provided by DOTA or a derivative thereof. More specifically, in one embodiment, the chelating polypeptides encompassed by the present disclosure are obtained by reacting the DOTA derivative 1,4,7,10-tetraazacyclododecane-1,4,7-tris-acetic acid-10-maleimidoethylacetamide (maleimidomonoamide-DOTA) with said polypeptide.

Additionally, 1,4,7-triazacyclononane-1,4,7-triacetic acid (NOTA) and derivatives thereof may be used as chelators. Hence, in one embodiment, there is provided an FcRn binding polypeptide, fusion protein or conjugate, wherein the polyaminopolycarboxylate chelator is 1,4,7-triazacyclononane-1,4,7-triacetic acid or a derivative thereof.

The most commonly used acyclic polyaminopolycarboxylate chelators are different derivatives of DTPA (diethylenetriamine-pentaacetic acid). Hence, polypeptides having a chelating environment provided by diethylenetriaminepentaacetic acid or derivatives thereof are also encompassed by the present disclosure.

In a further embodiment, the FcRn binding polypeptide, produced recombinantly through expression of a polynucleotide or synthetically, is conjugated to one or more synthetic polymers, in order for example to increase its hydrodynamic radius. Polyethylene glycol (PEG) is commonly used for this purpose, but other polymers have also been used in the art. Such "PEGylation" may be used to increase the size of the FcRn binding polypeptide of any of the types described herein to a size above the threshold for effective renal excretion.

In one embodiment, a synthetic polymer is conjugated to one or more chemically synthesized, monomeric FcRn binding polypeptides. Other functionalities may also be conjugated to the same synthetic polymer. If the FcRn binding polypeptide and other components are chemically synthesized, none of the components will have to be made in a biological system if this is not desired.

In a preferred embodiment, one or more synthetically or biologically manufactured FcRn binding polypeptides are conjugated to a synthetic polymer, to achieve a size exceeding the size associated with efficient renal clearance and used for blocking binding of IgG to FcRn. A unique cysteine in each FcRn binding polypeptide may be used for site specific conjugation, for example a C-terminally located cysteine introduced for this purpose. With a branched synthetic polymer, more than two FcRn binding moieties may be conjugated to the same polymer, to enhance the avidity and therefore the blocking potency.

In a third aspect of the present disclosure, there is provided a polynucleotide encoding an FcRn binding polypeptide or a fusion protein as described herein. Also encompassed by this disclosure is a method of producing a polypeptide or fusion protein as described above comprising expressing a polynucleotide; an expression vector comprising the polynucleotide; and a host cell comprising the expression vector.

Also encompassed is a method of producing a polypeptide, comprising culturing said host cell under conditions permissive of expression of said polypeptide from its expression vector, and isolating the polypeptide.

The FcRn binding polypeptide of the present disclosure may alternatively be produced by non-biological peptide synthesis using amino acids and/or amino acid derivatives having protected reactive side-chains, the non-biological peptide synthesis comprising
  step-wise coupling of the amino acids and/or the amino acid derivatives to form a polypeptide according to the first aspect having protected reactive side-chains,
  removal of the protecting groups from the reactive side-chains of the polypeptide, and
  folding of the polypeptide in aqueous solution.

In a fourth aspect of the disclosure, there is provided a composition comprising an FcRn binding polypeptide, fusion protein or conjugate as described herein and at least one pharmaceutically acceptable excipient or carrier. In one embodiment thereof, said composition further comprises at least one additional active agent, such as at least two additional active agents, such as at least three additional active agents. Non-limiting examples of additional active agents that may prove useful in such a combination are immunosuppressing agents, anti-inflammatory agents, antimicrobial agents and enzymes.

In one embodiment of this aspect, said composition is adapted for administration by a route selected from the group consisting of oral administration, intranasal administration, pulmonar administration, vaginal administration, rectal administration, intravenous injection, intraperitoneal injection, intramuscular injection, subcutaneous injection and intradermal injection.

As used herein, the term "systemic administration" refers to a route of administration such the substance of interest enters into the circulatory system so that the entire body is affected. The skilled person is aware that systemic administration can take place via enteral administration (absorption of the drug through the gastrointestinal tract) or parenteral administration (generally injection, infusion or implantation).

In one embodiment, said composition is adapted for administration systemically or locally. In certain embodiments, systemic administration of said compound may be used. In another embodiment, said composition is adapted for administration by a local route. For example, local administration may be topical in an ointment, paste, foam or cream. In another embodiment, said composition is adapted for administration across an endothelial or epithelial layer. Here, the composition may be transcytosed across said layer.

In one embodiment, the rate of uptake of a composition comprising a fusion protein or conjugate as described herein is higher than the rate of uptake of polypeptides corresponding to second or further moieties per se. In one embodiment, the rate of uptake is at least 2 times higher, such as at least 5 times higher, such as at least 10 times higher, such as at least 25 times higher than the rate of uptake of the at second or further moieties per se.

It should be understood from the above disclosure that the FcRn binding polypeptide fusion protein or conjugate or the composition as described herein may for example be useful as a therapeutic agent, and/or as a means for extending the in vivo half-life of a fusion partner, and/or as a means for increasing the rate of elimination of undesirable targets.

Hence, in a fifth aspect of the present disclosure, there is provided an FcRn binding polypeptide, fusion protein, conjugate or composition as disclosed herein for use as a medicament.

In a related, sixth, aspect of the present disclosure, there is provided a method of treatment of a subject in need thereof, comprising the step of administrating a therapeutically active amount of an FcRn binding polypeptide, fusion protein, conjugate or composition as disclosed herein.

In one embodiment of any one of these two latter aspects, the medicament or method is intended for treatment in which the capacity of the FcRn binding polypeptide to at least partially block binding of IgG to FcRn is exploited, i.e. treatment in which increased catabolism of IgG antibodies is desired. In one embodiment, a condition in which such treatment may be indicated is an auto-immune condition. As non-limiting examples of indicated conditions, mention is made of myasthenia gravis, Guillain-Barré syndrome, auto-immune limbic encephalitis, pediatric autoimmune neuropsychiatric disorders associated with streptococcal infection (PANDAS), neuromyotonia (Isaac's syndrome), morvan syndrome, multiple sclerosis, pemphigus vulgaris, foliaceus, bullous pemphigoid, epidermolysis bullosa acquisita, pemphigoid gestationis, mucous membrane pemphigoid, lichen sclerosus, antiphospholipid syndrome, erlapsing polychondritis, autoimmune anemia, idiopathic trombocytic purpura, autoimmune Grave's disease, dilated cardiomyopathy, vasculitis, Goodpasture's syndrome, idiopathic membranous nephropathy, rheumatoid arthritis and systemic lupus erythematosus.

In another embodiment, there is provided an FcRn binding polypeptide, fusion protein, conjugate or composition as described herein for use in blocking or removal of an undesirable target from the circulation. In one embodiment, said undesirable target is selected from the group comprising allergens, amyloids, antibodies, auto-antigens, blood clotting factors, hormones, tumor cells, drug molecules, cytokines, chemokines, hypersensitivity mediators, pro-inflammatory factors, toxins such as bacterial toxins and snake venoms, pollutants, metals and anti-oxidants.

While the invention has been described with reference to various exemplary aspects and embodiments, it will be understood by those skilled in the art that various changes may be made and equivalents may be substituted for elements thereof without departing from the scope of the invention. In addition, many modifications may be made to adapt a particular situation or molecule to the teachings of the invention without departing from the essential scope thereof. Therefore, it is intended that the invention not be limited to any particular embodiment contemplated, but that the invention will include all embodiments falling within the scope of the appended claims.

BRIEF DESCRIPTION OF THE FIGURES

FIGS. 1A-1NN is a listing of the amino acid sequences of examples of FcRn binding motifs comprised in FcRn binding polypeptides of the invention (SEQ ID NO:1-353), examples of 49-mer FcRn binding polypeptides according to the disclosure (SEQ ID NO:354-706), examples of 58-mer FcRn binding polypeptides according to the disclosure (SEQ ID NO:707-1062) as well as the amino acid sequences of the albumin binding polypeptide variant PP013 (SEQ ID NO:1063), Taq polymerase binding Z variant Z03638 (SEQ ID NO:1064), human αFcRn (SEQ ID NO:1065), murine αFcRn (SEQ ID NO:1070), human β2-microglobulin (SEQ ID NO:1066), murine β2-microglobulin (SEQ ID NO:1067), human αFcRn (SEQ ID NO:1068) when in human FcRn-eGFP and murine αFcRn (SEQ ID NO:1069) when in murine FcRn-eGFP.

FIGS. 7A-7C show kinetics of binding of three Z variants to human FcRn at pH 6.0, as described in Example 6, using a Biacore instrument. Sensorgrams for a concentration series of (A) Z11948 (SEQ ID NO:1060), (B) Z11946 (SEQ ID NO:1061) and (C) Z11947 (SEQ ID NO:1062), respectively, in fusion with the albumin binding polypeptide PP013 (SEQ ID NO:1063) and the control Z variant molecule Z03638 (SEQ ID NO:1064; not specific for FcRn), are displayed. Curves from 640 nM (dashed line), 160 nM (dotted line) and 40 nM (solid grey line) were subjected to kinetic analysis using the Langmuir 1:1 binding model. Kinetic parameters and affinities were calculated from fitted curves (solid black lines) and are shown in Table 5.

EXAMPLES

Summary

Figure 2A:
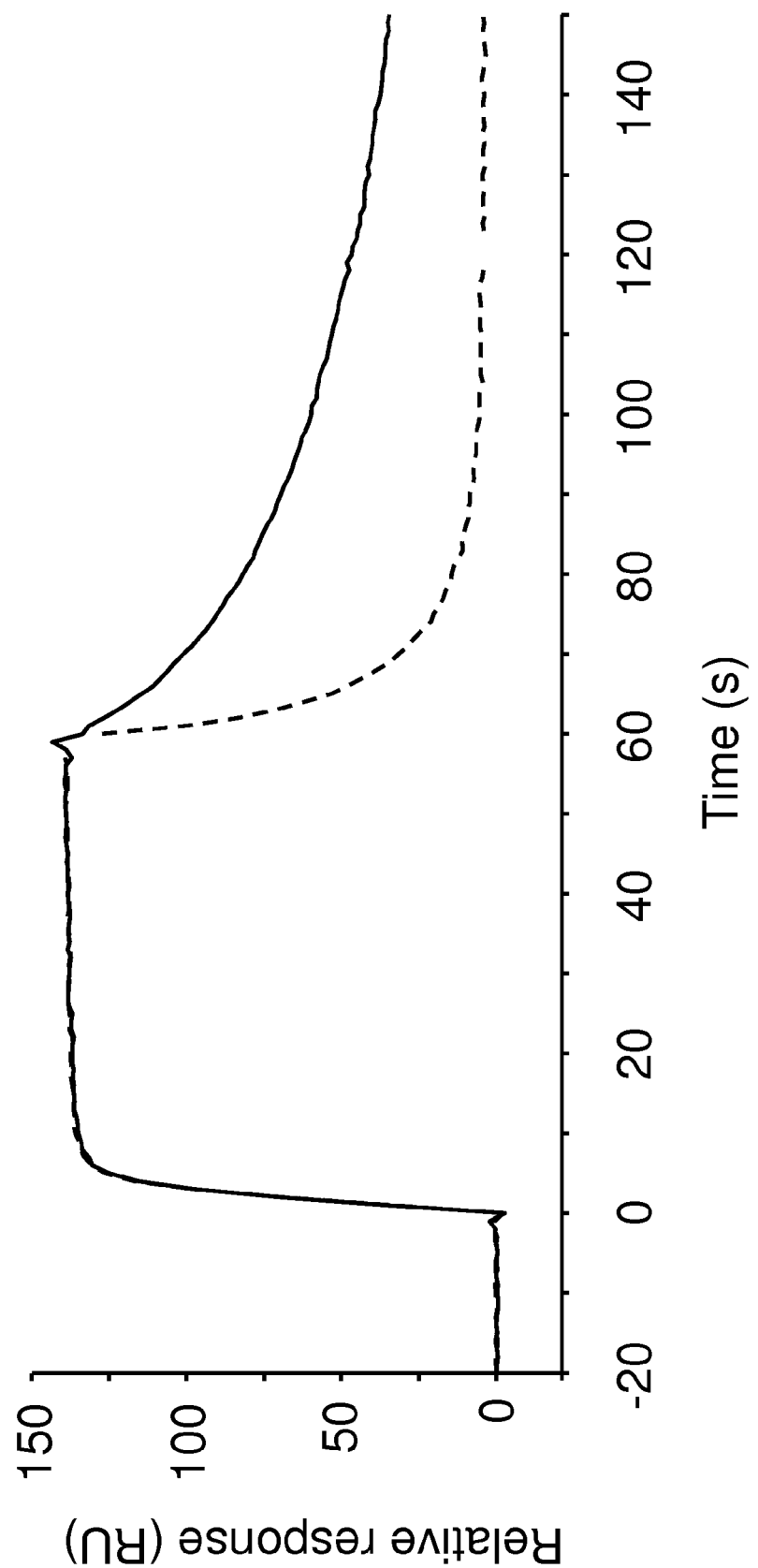
FIGS. 2A-2E show the binding to human FcRn at pH 6.0 and dissociations at pH 6.0 and 7.4 for $His_6$-tagged Z variants and for IgG as described in Example 3. Overlays of sensorgrams obtained from a Biacore instrument representing injection at pH 6.0 followed by dissociation at pH 6.0 (solid line) and injection at pH 6.0 followed by dissociation at pH 7.4 (dashed line) are displayed for (A) Z07918 (SEQ ID NO:707), (B) Z07960 (SEQ ID NO:710), (C) Z10109 (SEQ ID NO:709), (D) Z10193 (SEQ ID NO:708) and (E) IgG.
Figure 2B:
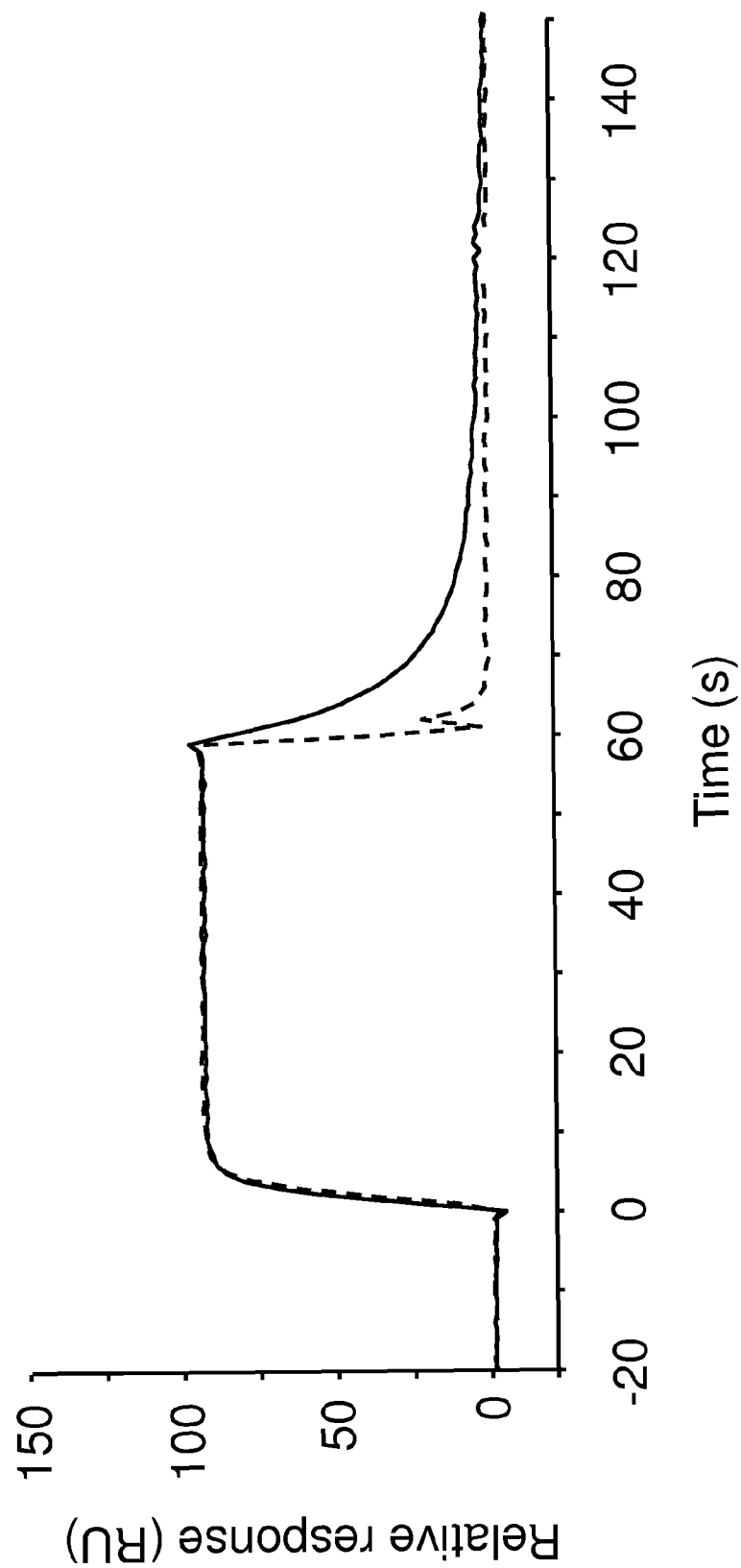
Figure 2C:
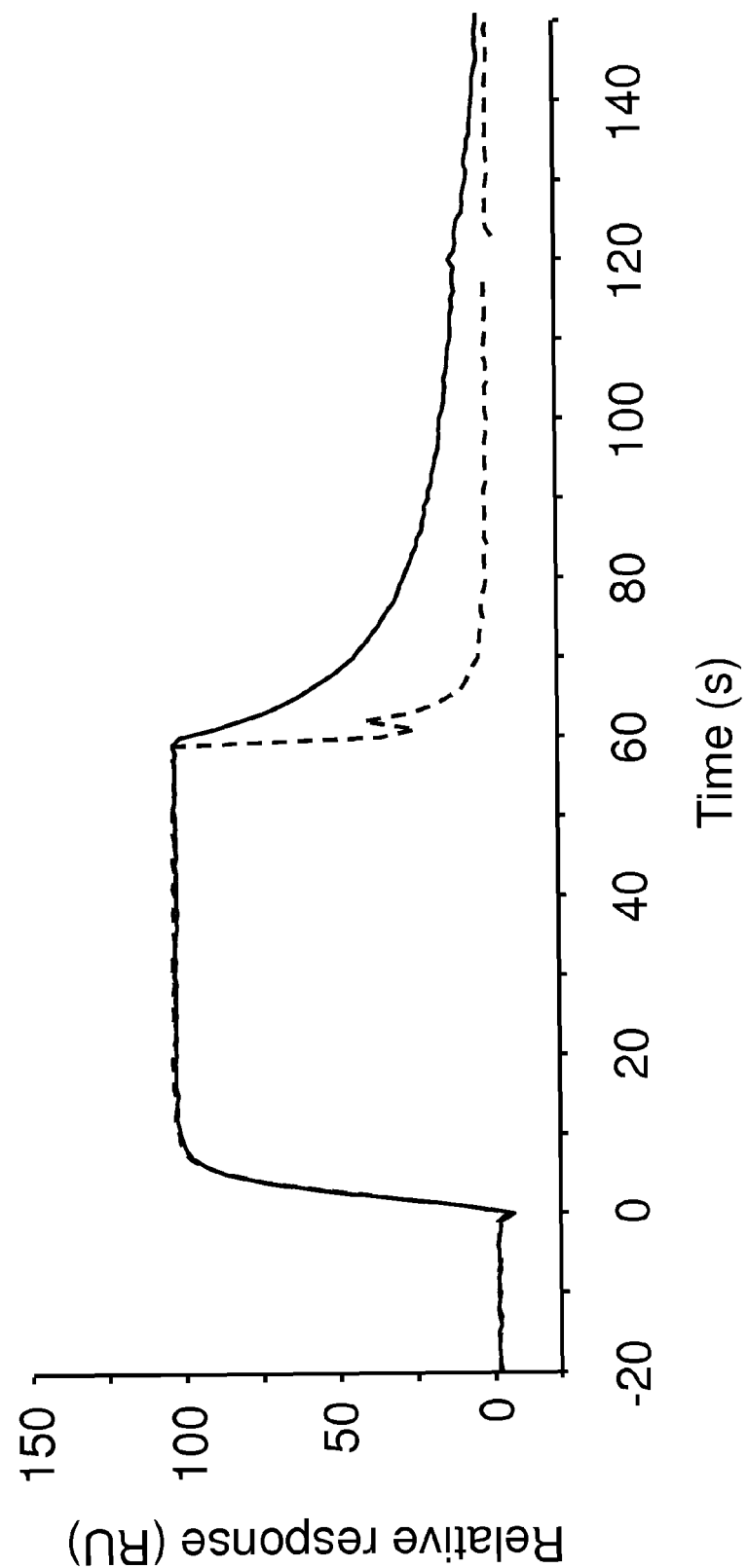
Figure 2D:
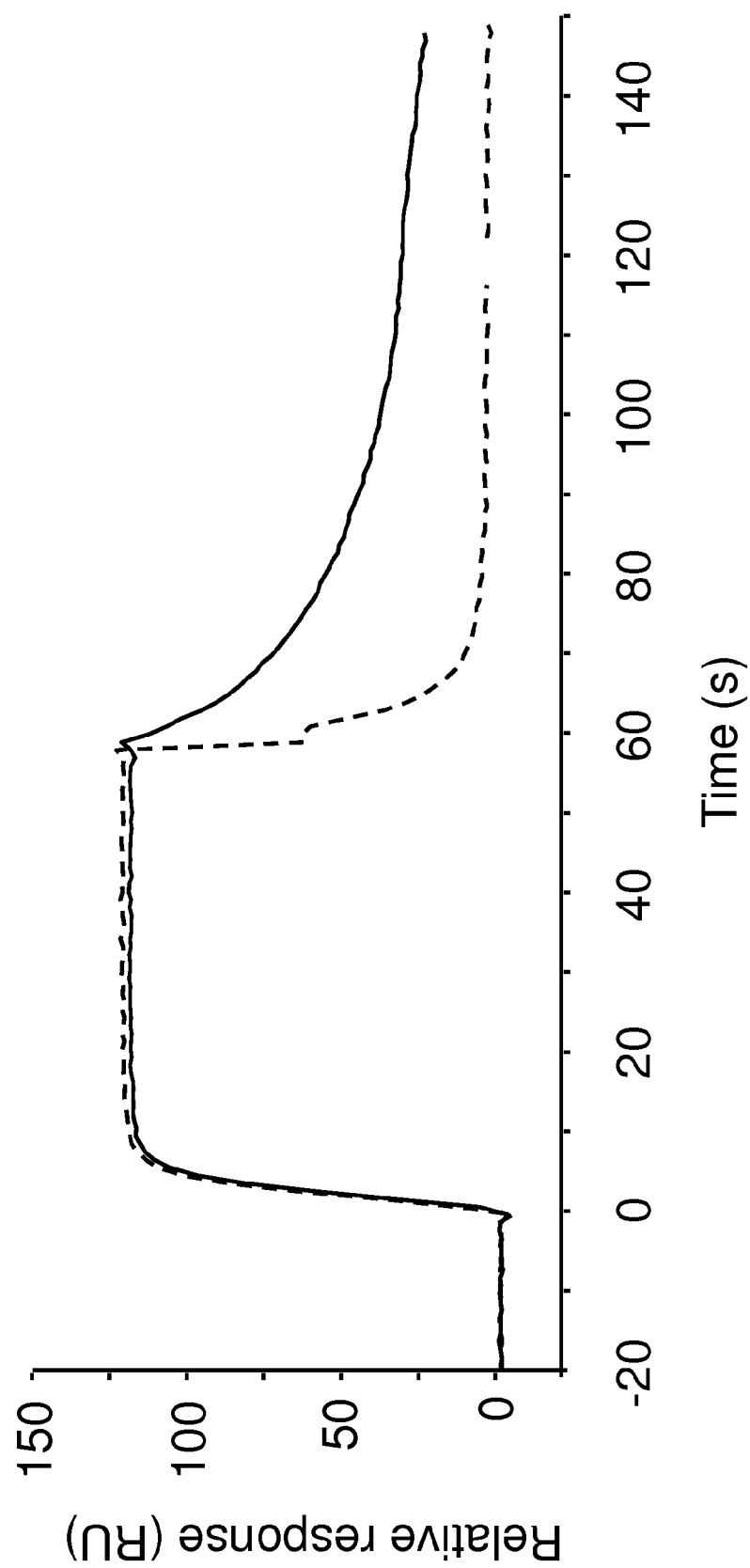
Figure 2E:
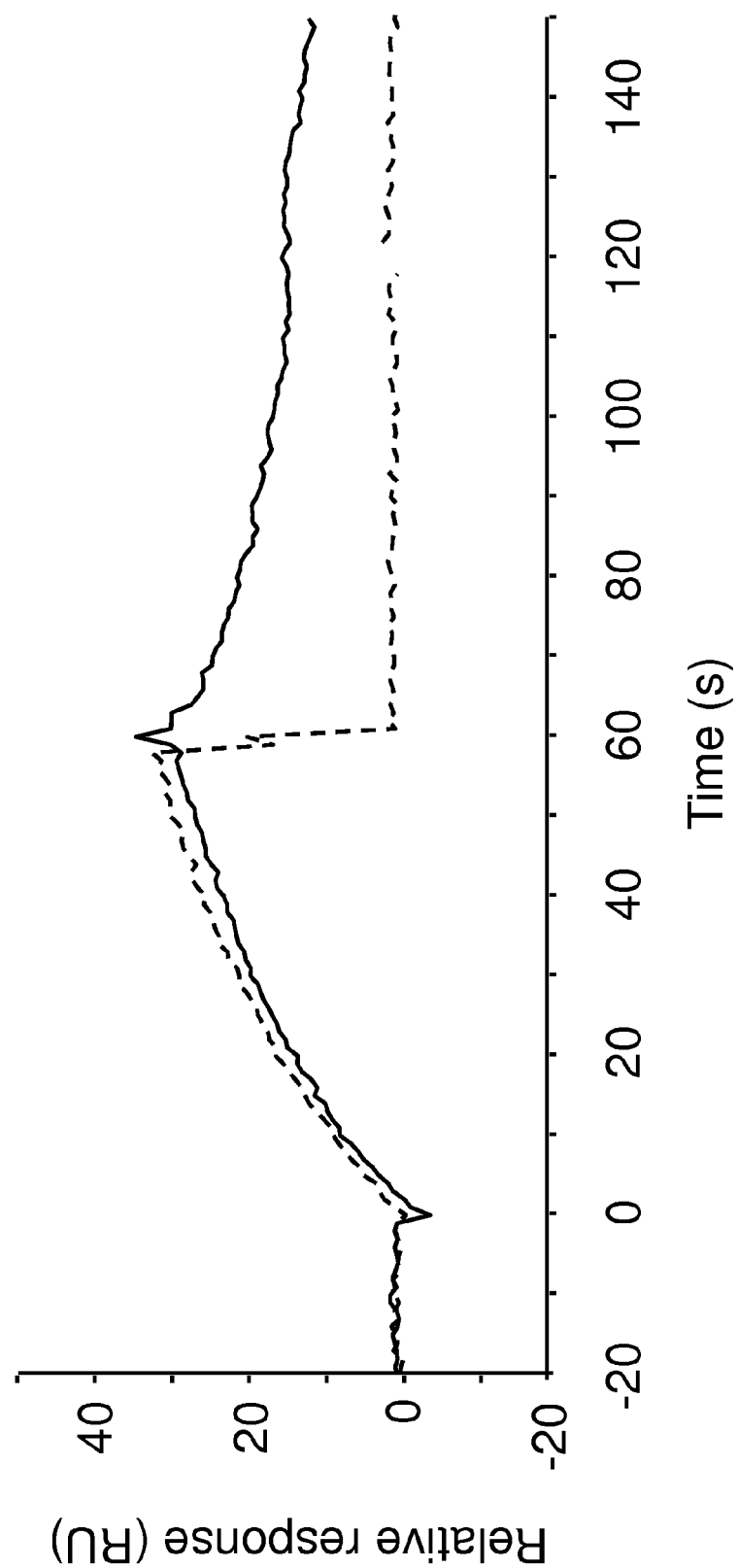

The following Examples disclose the development of novel Z variant molecules targeting the neonatal Fc receptor (FcRn). The Z variants were obtained using phage display technology. The genes encoding FcRn binding polypeptides described herein were sequenced, and the corresponding amino acid sequences are listed in FIGS. 1A-1NN, and denoted by the identifiers SEQ ID NO:707-1059. Also, the deduced binding motifs of these selected binding variants are listed in FIGS. 1A-1NN with sequence identifiers SEQ ID NO:1-353.

Example 1

Production of Human αFcRn and Human β2-Microglobulin (B2M)

In this Example, the extracellular domain (ECD) of human αFcRn (SEQ ID NO:1065) in complex with human β2-microglobulin (SEQ ID NO:1066) (complex denoted FcRn) and human β2-microglobulin in non-complexed form (denoted B2M) were produced as soluble proteins. Human FcRn and B2M produced in this Example were used for phage selection, ELISA and Biacore assays in Examples 2 and 3.

Materials and Methods

Construction of Plasmids Containing the Genes for Human αFcRn and Human β2-Microglobulin to be Used for Co-Expression:

The genes encoding human αFcRn (Genbank BC008734.2) and human β2-microglobulin (B2M) (Genbank BC032589.1) were obtained from OpenBiosystems. Using PCR overlap extension, a gene fragment encoding amino acids 24-290 of human αFcRn ($\alpha FcRn_{ECD}$) (SEQ ID NO:1065) was amplified to a construct consisting of attB1-site/Kozak sequence followed by a gene encoding: an Ig kappa chain leader sequence, $hFcRn_{ECD}$, a GS-linker and a flag tag, followed by an attB2 site. A similar construct was made containing a gene fragment encoding amino acids 21-119 of human B2M (SEQ ID NO:1066), except that a $His_6$ tag replaced the flag tag. The constructs were inserted into the plasmid pDONOR221 (Invitrogen, cat. no. 12536-017) by recombination using the Gateway system (Invitrogen, cat. no. 11789020, GATEWAY BP CLONASE II Enzyme mix), according to the manufacturer's recommendations. After verification of correct sequences, the human $\alpha FcRn_{ECD}$ construct was inserted into $2K7_{bsd}$ (Suter et al. (2006) Stem Cells 24:615-623) using multi-site gateway cloning together with the promoter-containing plasmid pENTR-CMV (Tai et al. (2012) PLoS One 7(9):e46269), resulting in the vector $2K7_{bsd}$-CMV-$hFcRn_{ECD}$. The human B2M gene construct was similarly inserted into $2K7_{neo}$ (Suter et al., supra), giving the vector $2K7_{neo}$-CMV-hB2M.

Cell Culture, Preparation of Recombinant Lentiviral Vectors and Gene Insertions into SKOV-3 Cell Line:

The HEK293T and SKOV-3 cell lines were obtained from ATCC. Cells were grown at 37° C. in a humidified incubator in the presence of 5% $CO_2$. Complete medium for the HEK293T cell line was Dulbeccos modified eagle medium (DMEM) supplemented with 10% fetal bovine serum (FBS), 1% Antibiotic Antimycotic Solution (AA) and 1% MEM Non-essential Amino Acid Solution (NEAA). Complete medium for the SKOV-3 cell line was McCoy's 5A medium supplemented with 10% FBS and 1% AA.

The plasmids $2K7_{bsd}$-CMV-$hFcRn_{ECD}$ and $2K7_{neo}$-CMV-hB2M were separately co-transfected together with VSV-G envelope and gag/pol packaging plasmid into HEK293T cells using calcium chloride transfection (Zufferey et al. (1997) Nat Biotechnol 15(9):871-5; Jakobsson et al. (2006) J Neurosci Res 84:58-67). HEK293 culture supernatants containing formed lentiviral particles with human $\alpha FcRn_{ECD}$ and human B2M transgenes, respectively, were cleared from cell debris by centrifugation and filtration. The two types of lentiviral particles were used to sequentially transduce SKOV-3 cells. Successful double integrants containing both the human $\alpha FcRn_{ECD}$ and the B2M genes were selected for by the addition of blasticidin (Invitrogen) and G418 sulfate (Invitrogen) to culture medium while passaging the cells for two weeks. The resulting, stably transduced SKOV-3 cell line was denoted SKOV-3 $hFcRn_{ECD}$/hB2M.

Expression of Recombinant Human FcRn:

SKOV-3 cells, co-expressing human $\alpha FcRn_{ECD}$ and B2M resulting in human FcRn, were expanded and $1.5 \times 10^7$ cells were seeded in a HYPERFlask (Corning) in 560 ml complete growth medium. After five days, when the cells had settled and multiplied, the medium was changed to complete growth medium without FBS. After five days, the culture was terminated and the supernatant was collected, passed through a 45 μm filter and frozen at −80° C.

Purification of Recombinant Human FcRn Using Human IgG Chromatography:

Protein purification was carried out in an ÄKTA Explorer system (GE Healthcare). Human IgG (Pharmacia), 1 ml in 0.2 M $NaHCO_3$, 0.5 M NaCl pH 8.3 at a concentration of 10 mg/ml, was coupled to a 1 ml HiTrap NHS-activated HP column (GE Healthcare) according to the manufacturer's instruction. The supernatant containing recombinant human FcRn from SKOV-3 cells was thawed and the pH was adjusted to 5.8 with HCl. The supernatant was subsequently loaded in batches of 100 ml onto the column previously equilibrated with 20 mM Bis-Tris pH 5.8. The column was washed with 20 ml of 20 mM Bis-Tris pH 5.8 and eluted in fractions of 1 ml using 50 mM Tris, pH 8.1. Buffer exchange to PBS (phosphate buffered saline, 10 mM phosphate, 137 mM NaCl, 2.68 mM KCl, pH 7.4) was performed using dialysis.

SDS-PAGE and Western Blot:

The purity of the eluted fractions from the protein purification was analyzed by SDS-PAGE and staining with GelCode Blue Stain Reagent (Pierce) and SILVERXPRESS Silver Staining Kit (Invitrogen). Western blotting was carried out using an Amersham HYBOND-C Extra nitrocellulose membrane (GE Healthcare). The membrane was blocked with 5% non-fat dry milk (Semper) in TBS+T (50 mM Trizma base, 150 mM NaCl, 0.05% Tween-20, pH 8) for 1 hour, then probed with a mixture of rabbit anti-FCGRT polyclonal antibody (Atlas Antibodies) at a concentration of 0.15 µg/ml and rabbit anti-B2M polyclonal antibody (Atlas Antibodies) at a concentration of 0.23 µg/ml in TBS+T. The membrane was subsequently incubated with stabilized goat anti-rabbit antibody conjugated with horse radish peroxidase (Pierce) diluted 1:10,000 in TBS+T. After addition of TMB Substrate (Pierce), an image of the membrane was acquired on Amersham Hyperfilm ECL (GE Healthcare). The Hyperfilm was processed using GBX developer and GBX fixer (Sigma-Aldrich).

Production of a Non-Complexed Form of Human B2M:

Human B2M was produced in *E. coli*. The expression and purification was performed essentially as described in Sandalova et al. (2005) Acta Chryst F61:1090-1093 and Michaëlsson et al. (2001) J Immunol 166:7327-7334. The purified protein, consisting of amino acids 21-119 of human B2M, in urea was subjected to arginine refolding as follows; 0.5 mg of B2M was rapidly added to 2 ml refolding buffer (20 ml 1 M Tris-HCl pH 8.0, 16.87 g L-Arginine (buffered with HCl), 0.8 ml 0.5 M EDTA, 61 mg GSSG, 307 mg GSH and milli-Q water to a final volume of 200 ml, pH 8.0, and supplemented with protease inhibitor (Roche, cat. no. 11 873 580 001)). The refolding procedure was performed at 4° C. during 4 hours. Refolded B2M protein was buffer exchanged to PBS using a PD-10 column (GE Healthcare).

Results

Construction of Plasmids Containing the Genes for Human αFcRn and Human β2-Microglobulin to be Used for Co-Expression:

Genes encoding the extracellular domain of the α-chain of human FcRn ($\alpha FcRn_{ECD}$) and human B2M were inserted into the lentiviral transfer plasmids $2K7_{bsd}$ and $2K7_{neo}$, respectively. In both cases, the inserted gene is under the control of a CMV promoter. The genes were extended so that the resulting proteins would have an Ig kappa chain leader sequence in the N-terminus to target the protein for export through the endoplasmic reticulum to the culture medium (the signal sequence was cleaved upon secretion). In addition, $\alpha FcRn_{ECD}$ had a C-terminal spacer sequence followed by a FLAG-tag for potential detection. Human B2M had a C-terminal spacer sequence followed by a $His_6$ tag for potential detection. The spacer sequence was added to enhance accessibility of the tag. The lentiviral transfer plasmids also contained two different antibiotic resistance genes to allow selection of cells where both constructs had been inserted.

Expression and Purification of Recombinant Human FcRn:

The genes encoding $\alpha FcRn_{ECD}$ and B2M were inserted into the genome of SKOV-3 by lentiviruses, and the resulting FcRn protein was secreted into the culture medium. To capture only FcRn having retained pH-dependent IgG binding, affinity chromatography using immobilized IgG was used where the receptor was captured at pH 5.8 and eluted at pH 8.1. Captured protein was eluted in three fractions.

SDS-PAGE and Western Blot:

To investigate the presence of two peptide chains ($\alpha FcRn_{ECD}$ and B2M) of the produced FcRn protein, and to analyze the purity of the eluted material, an SDS-PAGE analysis was performed on the eluted fractions. For the gel stained with GelCode Blue Stain, two bands were detected with molecular weights of 12 and 36 kDa, respectively. This corresponds approximately to the theoretical molecular weights of the non-glycosylated peptide chains of 12 kDa for B2M and 31 kDa for $\alpha FcRn_{ECD}$. The $\alpha FcRn_{ECD}$ part of the protein contains one glycosylation site and it was therefore expected that its molecular mass would be higher than 31 kDa. The gel was also silver stained to increase sensitivity and possibly detect impurities. A band of approximately 66 kDa was detected in the first eluted fraction, which could correspond to BSA (bovine serum albumin) originating from cell attachment. The total amount of protein recovered in fraction 2 and 3 corresponded to 1.4 mg/l culture medium. A western blot analysis on the pooled material was carried out, which showed essentially only the two major bands and in addition a very weak band below 12 kDa which might correspond to a degradation product.

Example 2

Selection and ELISA Binding of FcRn Binding Z Variants

In this Example, human FcRn was used as target in phage display selections using a phage library of Z variants. Selected clones were DNA sequenced, produced in *E. coli* periplasmic fractions and assayed against FcRn in ELISA (enzyme-linked immunosorbent assay).

Materials and Methods

Biotinylation of Target Protein FcRn and of B2M:

Human FcRn and human B2M, produced as described in Example 1, were biotinylated using No-Weigh EZ-Link Sulfo-NHS-LC-Biotin (Pierce, cat. no. 21327) at a 31× (FcRn) and 10× (B2M) molar excess, respectively, according to the manufacturer's recommendations. The reactions were performed at room temperature (RT) for 30 min. Subsequent buffer exchange to PBS was performed using Slide-a-lyzer dialysis cassettes (FcRn; Pierce, cat. no. 66380, 10,000 MWCO and B2M; Pierce, cat. no. 66333, 3,500 MWCO), according to the manufacturer's instructions.

Phage display selection of FcRn binding Z variants: A library of random variants of protein Z displayed on bacteriophage, constructed in phagemid pAY02592 essentially as described in Grönwall et al. (2007) J Biotechnol, 128:162-183, was used to select FcRn binding Z variants. In this library, an albumin binding domain (ABD, GA3 of protein G from *Streptococcus* strain G148) is used as fusion partner to the Z variants. The library is denoted Zlib006Naive.II and has a size of $1.5 \times 10^{10}$ library members (Z variants). *E. coli* RRIΔM15 cells (Rüther et al., (1982) Nucleic Acids Res 10:5765-5772) from a glycerol stock containing the phagemid library Zlib006Naive.II, were inoculated in 20 l of a defined proline free medium [dipotassium hydrogenphosphate 7 g/l, trisodium citrate dihydrate 1 g/l, uracil 0.02 g/l, YNB (DIFCO Yeast Nitrogen Base w/o amino acids, Becton Dickinson) 6.7 g/l, glucose monohydrate 5.5 g/l, L-alanine 0.3 g/l, L-arginine monohydrochloride 0.24 g/l, L-asparagine monohydrate 0.11 g/l, L-cysteine 0.1 g/l, L-glutamic acid 0.3 g/l, L-glutamine 0.1 g/l, glycine 0.2 g/l, L-histidine 0.05 g/l, L-isoleucine 0.1 g/l, L-leucine 0.1 g/l, L-lysine monohydrochloride 0.25 g/l, L-methionine 0.1 g/l, L-phenylalanine 0.2 g/l, L-serine 0.3 g/l, L-threonine 0.2 g/l, L-tryptophane 0.1 g/l, L-tyrosine 0.05 g/l, L-valine 0.1 g/l], supplemented with 100 µg/ml ampicillin. The cultivations were grown at 37° C. in a fermenter (Belach Bioteknik, BR20). When the cells reached an optical density at 600 nm ($OD_{600}$) of 0.75, approximately 2.6 l of the cultivation was infected using a 10× molar excess of M13K07 helper phage (New England Biolabs, cat. no. N0315S). The cells were incubated for 30 minutes, whereupon the fermenter was filled up to 20 l with TSB-YE (Tryptic Soy Broth-Yeast Extract; 30 g/l TSB, 5 g/l yeast extract) supplemented with 100 µM isopropyl-β-D-1-thiogalactopyranoside (IPTG) for induction of expression and with 25 µg/ml kanamycin and 12.5 µg/ml carbenicillin and grown at 30° C. for 22 h. The cells in the cultivation were pelleted by centrifugation at 15,900 g. The phage particles were precipitated from the supernatant twice in PEG/NaCl (polyethylene glycol/sodium chloride), filtered and dissolved in PBS and glycerol as described in Grönwall et al., supra. Phage stocks were stored at −80° C. before use.

Selections against biotinylated human FcRn were performed in four cycles divided in two different tracks. Phage stock preparation and selection procedure were performed essentially as described for selection against another biotinylated target in WO2009/077175. The amplification of phage between the selection cycles was performed by infecting E. coli RRIΔM15 with phage, then performing cultivation in solution as follows. Eluted phage and 10× excess of M13K07 helper phage compared to bacteria were allowed to simultaneously infect log phase bacteria at 37° C. for 30 min without rotation, followed by 30 min with slow rotation. Prior to infection, bacteria were grown to log phase in the defined proline free medium described above. Infected bacteria were pelleted by centrifugation at 4,300 g for 10 min and resuspended in 200 ml TSB+YE medium supplemented with 0.1 mM IPTG, 25 µg/ml kanamycin and 100 µg/ml ampicillin and cultivated at 30° C. overnight for phage production.

The selection buffer consisted of 100 mM sodium phosphate and 150 mM sodium chloride adjusted to pH 5.5 with hydrogen chloride and supplemented with 0.1% gelatin and 0.1% Tween-20. At selection, human serum albumin (HSA, Albucult, Novozymes) was added to the selection buffer to a final concentration of 1.5 µM. In order to reduce the amount of background binders, pre-selection was performed by incubation of phage stock with DYNABEADS M-280 Streptavidin (SA-beads, Dynal, cat. no. 112.06) for 1 hour at RT. A second pre-selection was performed during 30 min at RT against human B2M immobilized in immunotubes (Nunc, cat. no. 444474). 5 µg/ml of human B2M in carbonate buffer (Sigma, cat. no. 068K8214) was immobilized in the tube at 7° C. for >1 h. After washing twice with tap water, the tubes were blocked with PBS+0.5% casein (Sigma, cat. no. C8654) for 30 min at RT before use. All tubes and beads used in the selection were pre-blocked with PBS+0.1% gelatin. Selection was performed in solution at RT, followed by capture of target-phage complexes on SA-beads where 1 mg beads per 2.9 µg biotinylated FcRn were used. In cycle 1 of the selections, 100 nM biotinylated FcRn was used and two washes of two min each were performed using selection buffer. An increased stringency, using a lowered target concentration and an increased number of washes, was applied in the subsequent cycles: 50 nM/5 washes, 25 nM/8 washes and 10 nM/12 washes were applied in cycle 2, 3 and 4, respectively. After the washes, bound phage was eluted from the two selection tracks using two different procedures; 1) 500 µl 0.1 M glycine-HCl, pH 2.2, followed by immediate neutralization with 50 µl 1 M Tris-HCl, pH 8.0, and 450 µl PBS, or; 2) 500 µl of 100 mM sodium phosphate and 150 mM sodium chloride, pH 8.0 and neutralization with 500 µl PBS.

Sequencing:

PCR fragments were amplified from single colonies using a standard PCR program and the primers AFFI-21 (5'-tgcttccggctcgtatgttgtgtg (SEQ ID NO:1071)) and AFFI-22 (5'-cggaaccagagccaccaccgg (SEQ ID NO:1072)). Sequencing of amplified fragments was performed using the biotinylated oligonucleotide AFFI-72 (5'-biotin-cggaaccagagccaccaccgg (SEQ ID NO:1073)) and a BIGDYE Terminator v3.1 Cycle Sequencing Kit (Applied Biosystems), used in accordance with the manufacturer's protocol. The sequencing reactions were purified by binding to magnetic streptavidin coated beads (Detach Streptavidin Beads, Nordiag, cat. no. 2012-01) using a Magnatrix 8000 (Magnetic Biosolution), and analyzed on ABI (PRISM) 3130xl Genetic Analyzer (PE Applied Biosystems).

Production of Z Variants for ELISA:

Sequenced Z variants were produced by inoculating single colonies from the selections into 10 ml TSB-YE medium supplemented with 100 µg/ml ampicillin and 0.1 mM IPTG and incubating for 24 h at 37° C. Cells were pelleted by centrifugation, re-suspended in 2 ml PBST (PBS supplemented with 0.05% Tween-20), frozen at −80° C. and thawed in a water bath, to release the periplasmic fraction of the cells. The freeze-thawing procedure was repeated seven times and cells were then pelleted by centrifugation. The supernatant of the periplasmic extract contained the Z variants as fusions to ABD, expressed as AQHDEALE-[Z#####]-VDYV-[ABD]-YVPG (SEQ ID NO: 1100) (Grönwall et al., supra). Z##### refers to individual, 58 amino acid residue Z variants.

ELISA $K_D$ Analysis of Z Variants:

The binding of Z variants to FcRn was analyzed in ELISA assays. Half-area 96-well ELISA plates were coated with 2 µg/ml of an anti-ABD goat antibody (produced in-house) diluted in coating buffer (50 mM sodium carbonate, pH 9.6) at 4° C. overnight. The antibody solution was poured off and the wells were blocked with 100 µl of PBSC (PBS supplemented with 0.5% casein) for 1.5 h at RT. The blocking solution was discarded and 50 µl periplasmic solution, diluted 1:4, was added to the wells and incubated for 1.5 h at RT under slow shaking. The solutions were poured off and the wells were washed four times with either 0.05% PCT buffer, pH 6.0 (McIlvaines phosphate-citrate buffer, pH 6.0, supplemented with 0.05 Tween-20) or 0.05% PCT buffer, pH 7.4 (McIlvaines phosphate-citrate buffer, pH 7.4, supplemented with 0.05% Tween-20). The target protein, biotinylated human FcRn, was added to the wells in a 1:3 diluted concentration series from 2 µg/ml (45 nM) to 0.3 ng/ml (6.9 pM) diluted in PCC buffer, pH 6.0 or pH 7.4, (McIlvaines phosphate-citrate buffer, pH 6.0 or pH 7.4, supplemented with 0.5% casein), respectively. The plates were incubated for 1.5 h at RT followed by washes as described above. Streptavidin conjugated HRP (Thermo Scientific, cat. no. N100) was diluted 1:30 000 in PCC buffer, pH 6.0 or pH 7.4, respectively, and added to the wells followed by 45 min incubation. After washing as described above, 50 µl ImmunoPure TMB substrate (Thermo Scientific, cat. no. 34021) was added to the wells and the plates were treated according to the manufacturer's recommendations. Absorbance was measured at 450 nm using a multi-well plate reader, Victor[3] (Perkin Elmer). A Z variant binding an irrelevant protein was used as negative control and a blank was created by omitting the periplasmic step. A Z variant which bound to FcRn in a pre-experiment (Z07918, SEQ ID NO:707) was used as positive control. Measured values were analyzed using GraphPad Prism 5 (GraphPad Software, LaJolla, Calif., USA) and non-linear regression in order to determine the affinities ($K_D$) of the interactions.

ELISA Specificity Analysis of Z Variants:

In another ELISA experiment, the specificities of the Z variants were tested by assaying them against 2 µg/ml biotinylated human proteins B2M, PSMA (in house produced) and IgG (polyclonal, Pharmacia, Sweden) and against PCC buffer pH 6.0 or pH 7.4, respectively. The assay was performed at pH 6.0 and at pH 7.4, respectively, as described above. The biotinylated proteins or buffer were added to the wells instead of FcRn in the target protein step.

Results

Phage Display Selection of FcRn Binding Z Variants:

Individual clones were obtained after four cycles of phage display selections against biotinylated human FcRn.

Sequencing:

Sequencing was performed on clones picked at random from selection round four. Each Z variant was given a unique identification number ##### and individual variants are referred to as Z#####. The amino acid sequences of the 58 amino acid residues long Z variants are listed in FIGS. 1A-1NN as SEQ ID NO:707-722 and SEQ ID NO:1059.

The deduced FcRn binding motifs of these Z variants are listed in FIGS. 1A-1NN as SEQ ID NO:1-16 and SEQ ID NO:353. The amino acid sequences of the 49 amino acid residues long polypeptides predicted to constitute the complete three-helix bundle within each of these Z variants are listed in FIGS. 1A-1NN as SEQ ID NO:354-369 and SEQ ID NO:706.

ELISA Assays with Z Variants:

Sixteen clones were produced as ABD fusion proteins in E. coli. The periplasmic fractions were used in an ELISA against a dilution series of human FcRn. The clones were: Z07909 (SEQ ID NO:719), Z07918 (SEQ ID NO:707), Z07930 (SEQ ID NO:712), Z07960 (SEQ ID NO:710), Z10109 (SEQ ID NO:709), Z10111 (SEQ ID NO:714), Z10127 (SEQ ID NO:718), Z10129 (SEQ ID NO:715), Z10140 (SEQ ID NO:711), Z10141 (SEQ ID NO:716), Z10145 (SEQ ID NO:721), Z10152 (SEQ ID NO:720), Z10156 (SEQ ID NO:717), Z10161 (SEQ ID NO:722), Z10183 (SEQ ID NO:713) and Z10193 (SEQ ID NO:708). $K_D$ values were determined for all variants at pH 6.0 and for three variants at pH 7.4 (Table 1). For thirteen variants, data was not obtained for a $K_D$ analysis at pH 7.4. None of the sixteen variants displayed non-specific binding when assayed against human B2M, IgG or PSMA.

TABLE 1

ELISA $K_D$ analysis of Z-ABD variants in E. coli periplasmic fractions.

| Z variant | SEQ ID NO: | $K_D$ pH 6.0 (M) | $K_D$ pH 7.4 (M) |
|---|---|---|---|
| Z07909 | 719 | $24.5 \times 10^{-9}$ | n.d. |
| Z07918 | 707 | $2.0 \times 10^{-9}$ | $10.9 \times 10^{-9}$ |
| Z07930 | 712 | $10.4 \times 10^{-9}$ | n.d. |
| Z07960 | 710 | $6.0 \times 10^{-9}$ | n.d. |
| Z10109 | 709 | $3.9 \times 10^{-9}$ | $23.9 \times 10^{-9}$ |
| Z10111 | 714 | $11.4 \times 10^{-9}$ | n.d. |
| Z10127 | 718 | $21.3 \times 10^{-9}$ | n.d. |
| Z10129 | 715 | $17.6 \times 10^{-9}$ | n.d. |
| Z10140 | 711 | $8.8 \times 10^{-9}$ | n.d. |
| Z10141 | 716 | $21.2 \times 10^{-9}$ | n.d. |
| Z10145 | 721 | $42.0 \times 10^{-9}$ | n.d. |
| Z10152 | 720 | $24.6 \times 10^{-9}$ | n.d. |
| Z10156 | 717 | $21.3 \times 10^{-9}$ | n.d. |
| Z10161 | 722 | $163.0 \times 10^{-9}$ | n.d. |
| Z10183 | 713 | $10.9 \times 10^{-9}$ | n.d. |
| Z10193 | 708 | $2.3 \times 10^{-9}$ | $25.9 \times 10^{-9}$ | n.d. = not determinable

Example 3

Production and Characterization of FcRn Binding Z Variants

In this Example, seventeen Z variants were produced in E. coli, purified and assayed against human FcRn in Biacore. A subset of said variants was also assayed against mouse FcRn. Circular dichroism (CD) spectroscopy was performed for a subset of Z variants for investigation of their secondary structure.

Materials and Methods

Subcloning of Z Variants:

The DNA of seventeen FcRn binding Z variants (SEQ ID NO:707-722 and SEQ ID NO:1059) was amplified from the library vector pAY02592. A subcloning strategy for construction of monomeric Z variant molecules with N-terminal His$_6$ tag was applied using standard molecular biology techniques (essentially as described in detail in WO2009/077175 for Z variants binding another target). The Z gene fragments were subcloned into the expression vector pAY01448 resulting in the encoded sequence MGSSHHH-HHHLQ-[Z#####]-VD (SEQ ID NO: 1101).

In addition, the FcRn binding variant Z07918 (SEQ ID NO:707), but starting with the amino acids AE instead of VD and denoted Z11948 (SEQ ID NO:1060), was cloned as homodimeric constructs with two different linkers between the Z variants and followed by a C-terminal His$_6$ tag. This was performed using conventional molecular biology methods including DNA amplification, restriction with suitable restriction enzymes and ligation of the DNA. The two linkers were obtained from Thermo Fisher Scientific. The Z gene fragments were subcloned into the expression vector (pET-26 origin, Novagen) resulting in the encoded sequence [Z#####]-GT-(G$_4$S)-PR-[Z#####]-LEHHHHHH (SEQ ID NO: 1102) and [Z#####]-GT-(G$_4$S)$_3$-[Z#####]-LEHHH-HHH (SEQ ID NO: 1103), respectively.

Cultivation and Purification:

E. coli BL21(DE3) cells (Novagen) were transformed with plasmids containing the gene fragment of each respective FcRn binding Z variant and cultivated at 37° C. in 800 or 1000 ml of TSB-YE medium supplemented with 50 µg/ml kanamycin. At OD$_{600}$=2, IPTG was added to induce expression at a final concentration of 0.17 or 0.2 mM and the culture was incubated at 37° C. for another 5 h. The cells were harvested by centrifugation.

Approximately 2-5 g of each cell pellet was resuspended in 10-25 ml binding buffer (20 mM sodium phosphate, 0.5 M NaCl, 20 mM imidazole, pH 7.4) supplemented with BENZONASE (Merck, cat. no. 1.01654.0001) to a concentration of 15 U/ml and Lysozyme (Sigma, cat. no. L-7651) to a concentration of 0.5 mg/ml. After cell disruption by three freeze-thawing cycles or sonication, cell debris was removed by centrifugation and each supernatant was applied on a 1 ml His GraviTrap IMAC column (GE Healthcare, cat. no. 11-0033-99). Contaminants were removed by washing with wash buffer (20 mM sodium phosphate, 0.5 M NaCl, 20 or 60 mM imidazole, pH 7.4), and the FcRn binding Z variants were subsequently eluted with elution buffer 1 (20 mM sodium phosphate, 0.5 M sodium chloride, 250 mM imidazole, pH 7.4) or elution buffer 2 (0.1 M acetic acid, 0.5 M sodium chloride, pH 4.5). Purified Z variants were buffer exchanged to PBS using PD-10 columns (GE Healthcare), according to the manufacturer's protocol. Protein concentrations were determined by measuring the absorbance at 280 nm, using a NANODROP ND-1000 spectrophotometer, and using the extinction coefficient of the respective protein. The purity of the FcRn binding Z variants was analyzed by SDS-PAGE stained with Coomassie Blue. The identity of each purified FcRn binding Z variant was confirmed using LC/MS analysis.

CD Analysis:

Purified $His_6$-tagged Z variants were diluted to 0.5 mg/ml in PBS. For each diluted Z variant, a CD spectrum at 250-195 nm or 250-190 nm was obtained at 20° C. In addition, a variable temperature measurement (VTM) was performed to determine the melting temperature (Tm). In the VTM, the absorbance was measured at 221 nm while the temperature was raised from 20 to 90° C., with a temperature slope of 5° C./min. A new CD spectrum was obtained at 20° C. after the heating procedure in order to study the refolding ability of the Z variants. The CD measurements were performed on a Jasco J-810 spectropolarimeter (Jasco Scandinavia AB) using a cell with an optical path-length of 1 mm.

Biacore Binding and Kinetic Analysis:

The interaction of FcRn binding $His_6$-tagged Z variants with human FcRn was analyzed in a Biacore 2000 instrument (GE Healthcare). Human FcRn was immobilized in a flow cell on the carboxylated dextran layer of a CM5 chip surface (GE Healthcare). The immobilization was performed using amine coupling chemistry according to the manufacturer's protocol and using HBS-EP (GE Healthcare) as running buffer. One flow cell surface on the chip was activated and deactivated for use as blank during analyte injections. In the two binding experiments presented below, McIlvaines phosphate-citrate buffer pH 6.0 supplemented with 0.005% Tween-20 (0.005% PCT) was used as running buffer. In all experiments, a flow rate of 50 µl/min was used.

In one experiment, the dissociation at pH 6.0 was compared to the dissociation at pH 7.4. $His_6$-tagged Z variants and a human monoclonal IgG1 were diluted in running buffer to a final concentration of 250 nM or 2.5 nM, respectively, and injected over the FcRn chip for 1 minute using the co-inject procedure. The second injection of the co-inject procedure, representing the dissociation phase of the interactions, contained either running buffer (pH 6.0) or 0.005% PCT pH 7.4. The Z variants were allowed to dissociate for 1 minute, except for Z07918 and Z10193, which were allowed to dissociate for 4 minutes, before a surface equilibration during 5 minutes in running buffer. IgG was allowed to dissociate for 4 minutes before equilibration. Buffer injections were performed in a similar way; co-injection of buffer pH 6.0 followed by pH 6.0 or co-injection of buffer pH 6.0 followed by pH 7.4. The results were analyzed in BiaEvaluation software 4.1 (GE Healthcare). Curves of the blank surface were subtracted from the curves of the ligand surface. In addition, curves of buffer injections were subtracted from the Z variant curves and from the IgG curves to adjust for the buffer effects.

In another experiment, approximate kinetic constants ($k_{on}$ and $k_{off}$) and affinities ($K_D$) were determined for a subset of $His_6$-tagged Z variants. Three concentrations of the Z variants were injected for 1 minute followed by dissociation in running buffer for 1 minute. The surfaces were equilibrated with running buffer during 7.5 minutes before the start of next cycle. Injected concentrations were either 675 nM, 225 nM and 75 nM (Z10140, Z10156 and Z10183) or 225 nM, 75 nM and 25 nM (Z07918 and Z10193). Kinetic constants were calculated from the sensorgrams using the Langmuir 1:1 model of BiaEvaluation software 4.1 (GE Healthcare).

In a separate experiment, the affinity of the interactions of Z variants to hFcRn (SEQ ID NO:1065) and mFcRn (SEQ ID NO:1070), respectively, was measured at both pH 6.0 and pH 7.4 on a Biacore 3000 instrument (GE Healthcare). hFcRn and mFcRn were produced essentially as described in Example 1 but using mouse 3T3 cells instead of human SKOV-3 cells for production of mFcRn, and immobilized on separate flow cells on a CM5 chip in acetate buffer at pH 4.65. The immobilization level was approximately 1000 RU for both receptors. A reference flow cell was created by activation and deactivation. 0.005% PCT pH 6.0 or 7.4 was used as running buffer and for dilution of the analytes. All analyses were performed at 25° C. The affinity constants for the $His_6$-tagged Z variants Z07918 (SEQ ID NO:707), Z07960 (SEQ ID NO:710) and Z10193 (SEQ ID NO:708) were determined by injecting a dilution series from 1024 nM to 0.5 nM (pH 6.0) or from 10240 nM to 5 nM (pH 7.4). The affinities were derived using GraphPad Prism 5 software, using a one site binding saturation model.

AlphaLISA Blocking Assay:

The potential of Z variants to inhibit binding of IgG to FcRn was analyzed in an AlphaLISA assay with an EnSpire multiplate reader 2300 (Perkin Elmer). Human IgG (Roactemra) was immobilized on AlphaLISA acceptor beads (Perkin Elmer, cat. no. 6772002) according to the manufacturer's recommendations. Stepwise serial dilutions 1:3 of His-tagged Z variants to final concentrations of 250 nM to 38 pM were made in a 384-well plate (Perkin Elmer, cat. no. G6005350) and incubated for 45 min with 10 nM biotinylated human FcRn (Biorbyt, cat. no. orb84388; biotinylated essentially as described in Example 2) in AlphaLISA buffer (Perkin Elmer, cat. no. AL00F) adjusted to pH 6.0 using HCl. IgG-coated Acceptor beads were added to a final concentration of 10 µM and incubated for 45 min. Finally, streptavidin coated Donor beads (Perkin Elmer, cat. no. 6772002) were added to a final concentration of 40 µg/ml and incubated for 30 min. All incubations were performed at RT in the dark. The plate was analyzed in the EnSpire instrument and the IC50 values were calculated using GraphPad Prism 5.

Results

Cultivation and Purification:

The seventeen FcRn binding Z variants (SEQ ID NO: 707-722 and SEQ ID NO:1059), constructed with an N-terminal $His_6$ tag, were produced in E. coli. The amount of IMAC-purified protein from approximately 2-5 g bacterial pellets, determined spectrophotometrically by measuring the absorbance at 280 nm, ranged from approximately 10 mg to 20 mg for the different FcRn binding Z variants. SDS-PAGE analysis of each final protein preparation showed that these predominantly contained the FcRn binding Z variant. The correct identity and molecular weight of each FcRn binding Z variant was confirmed by HPLC-MS analysis.

CD Analysis:

The CD spectra determined for six Z variants showed that each had an α-helical structure at 20° C. This result was also verified in the variable temperature measurements, wherein melting temperatures (Tm) were determined (Table 2). A reversible folding was seen for the six Z variants when overlaying spectra measured before and after heating to 90° C.

TABLE 2

Melting temperatures for a selection of Z variants.

| Z variant | SEQ ID NO: | Tm (° C.) |
|---|---|---|
| Z07909 | 719 | 56 |
| Z07918 | 707 | 49 |
| Z07930 | 712 | 56 |
| Z07960 | 710 | 58 |
| Z10109 | 709 | 61 |
| Z10193 | 708 | 59 |

Biacore Binding and Kinetic Analyses:

The binding of seventeen Z variants to human FcRn and the dissociation at different pH were tested in a Biacore instrument by sequentially injecting each of the Z variants at pH 6.0 and either buffer pH 6.0 or pH 7.4 over a chip surface containing FcRn. The ligand immobilization level of the surface was 1668 RU human FcRn. The seventeen Z variants showed binding to FcRn at pH 6.0, and for all variants, faster off-rates were seen at pH 7.4 compared to pH 6.0. The result for IgG was similar, displaying a faster off-rate at pH 7.4. The variants Z07918 and Z10193 showed the slowest dissociation curves. Sensorgrams for a subset of variants and IgG are displayed in FIGS. 2A-E.

TABLE 3

Biacore kinetic constants and affinities for hFcRn binding at pH 6.0.

| Z variant | SEQ ID NO: | $k_{on}$ (M$^{-1}$s$^{-1}$) | $k_{off}$ (s$^{-1}$) | $K_D$ (M) |
|---|---|---|---|---|
| Z07918 | 707 | $1.4 \times 10^6$ | 0.022 | $1.6 \times 10^{-8}$ |
| Z10140 | 711 | $1.4 \times 10^6$ | 0.12 | $8.6 \times 10^{-8}$ |
| Z10156 | 717 | $7.6 \times 10^5$ | 0.28 | $3.7 \times 10^{-7}$ |
| Z10183 | 713 | $1.0 \times 10^6$ | 0.13 | $1.3 \times 10^{-7}$ |
| Z10193 | 708 | $1.5 \times 10^6$ | 0.033 | $2.2 \times 10^{-8}$ |

The kinetic constants of five Z variants interacting with FcRn at pH 6.0 were determined (see Table 3). The immobilization level of the surface was 2015 RU human FcRn. For each Z variant, kinetic constants were calculated using a curve set of three injected concentrations.

Affinity ($K_D$) constants were also determined for His$_6$-tagged Z variants Z07918 (SEQ ID NO:707), Z07960 (SEQ ID NO:710) and Z10193 (SEQ ID NO:708) interacting with human and mouse FcRn at pH 6.0 and pH pH 7.4 (Table 4). For all three variants, $K_D$ values were lower at pH 6.0 compared to pH 7.4.

TABLE 4

Biacore affinities for hFcRn and mFcRn at pH 6.0 and pH 7.4.

| Z variant | SEQ ID NO: | $K_D$ (M) hFcRn | | $K_D$ (M) mFcRn | |
|---|---|---|---|---|---|
| | | pH 6.0 | pH 7.4 | pH 6.0 | pH 7.4 |
| Z07918 | 707 | $1.2 \times 10^{-8}$ | $>5 \times 10^{-7}$ | $9.0 \times 10^{-8}$ | $>5 \times 10^{-7}$ |
| Z07960 | 710 | $5.0 \times 10^{-8}$ | $>1 \times 10^{-6}$ | $3.5 \times 10^{-7}$ | $>5 \times 10^{-6}$ |
| Z10193 | 708 | $1.4 \times 10^{-8}$ | $>5 \times 10^{-7}$ | $9.5 \times 10^{-8}$ | $>5 \times 10^{-7}$ |

TABLE 5

Calculated IC50 values from AlphaLISA blocking assay.

| Z variant | SEQ ID NO of Z variant | IC50 (M) |
|---|---|---|
| Z07909 | 719 | $4.6 \times 10^{-8}$ |
| Z07918 | 707 | $2.1 \times 10^{-9}$ |
| Z07930 | 712 | $4.2 \times 10^{-8}$ |
| Z07960 | 710 | $4.2 \times 10^{-8}$ |
| Z10109 | 709 | $5.7 \times 10^{-8}$ |
| Z10111 | 714 | $4.6 \times 10^{-8}$ |
| Z10140 | 711 | $5.6 \times 10^{-8}$ |
| Z10183 | 713 | $3.9 \times 10^{-8}$ |
| Z10193 | 708 | $1.2 \times 10^{-8}$ |
| Z13993 | 1059 | $1.3 \times 10^{-7}$ |
| Z11948-G$_4$S-Z11948 | 1060 | $3.8 \times 10^{-10}$ |
| Z11948-(G$_4$S)$_3$-Z11948 | 1060 | $4.1 \times 10^{-10}$ |

AlphaLISA blocking assay: The ability of seventeen His$_6$-tagged monomeric Z variants (SEQ ID NO:707-722 and SEQ ID NO:1059) and two dimeric variant, Z11948-G$_4$S-Z11948 and Z11948-(G$_4$S)$_3$-Z11948 to inhibit IgG binding to FcRn was tested in an AlphaLISA blocking assay. Serial dilutions of the Z variants were incubated with biotinylated human FcRn and the blocking ability of each respective variant was measured after addition of IgG coated Acceptor beads and subsequently streptavidin coated Donor beads. Inhibition could be measured as a decrease in AlphaLISA counts for positive Z variants. The calculated IC50 values for the ten monomeric variants and the two dimeric variants that were shown to block IgG binding to FcRn in this assay are shown in Table 5.

Example 4

Binding of FcRn Binding Z Variants to Human or Mouse FcRn/eGFP Transfected HeLa Cells In this example, the binding ability of FcRn binding Z variants was investigated. The production of HeLa cells expressing human and murine FcRn-eGFP gene transgene and the use of these cells for flow cytometry analysis with Alexa647 labeled Z variants is described.

Materials and Methods

Cloning of FcRn-eGFP and B2M Viral Vectors:

The genes encoding murine FcRn (mFcRn, Genbank BC003786.1, OpenBiosystems) and murine B2M (mB2M, Genbank BC085164.1, OpenBiosystems) were amplified in a similar way as the genes for human FcRn and human B2M as described in Example 1. Human and murine FcRn and B2M genes were amplified as follows: for hFcRn, the sequence encoding amino acids 1-365 (SEQ ID NO:1068) was amplified; for hB2M, the sequence encoding amino acids 21-119 (SEQ ID NO:1066) was amplified; for mFcRn, the sequence encoding amino acids 1-369 (SEQ ID NO:1069) was amplified; and for mB2M, the sequence encoding amino acids 21-119 (SEQ ID NO:1067) was amplified. The vector pHR-cPPT-CMV-EGFP (Jakobsson et al. (2003) J Neurosci Res 73:876-85) and FcRn PCR amplicons (human and murine) were cut using the restriction enzymes BamHI (human) or BclI (murine) and MluI (New England Biolabs, cat. nos. R0136M, R0160L and R0198L, respectively), and ligated using T4 DNA Ligase (New England Biolabs, cat. no. M0202M). The ligation mix was chemically transformed into E. coli RRIΔM15 and spread on ampicillin plates. Colonies were picked and screened with suitable primer pairs. The construct encoding the original signal peptide, human or murine FcRn and eGFP at the cytoplasmic tail were verified by sequencing and denoted pHR-cPPT-CMV-hFcRn-eGFP and pHR-cPPT-CMV-mFcRn-eGFP, respectively.

The human and murine B2M PCR amplicons were inserted into the plasmid pDONOR221 (Invitrogen, cat. no. 12536-017) by recombination using the Gateway system (Invitrogen, cat. no. 11789020, GATEWAY BP CLONASE II Enzyme mix) according to the manufacturer's recommendations. After verification of correct sequences, human or murine B2M was inserted into p2k7_gtc (Suter et al., supra) using a multi-site gateway cloning system (Invitrogen, cat. no. 11791020, GATEWAY LR CLONASE II Enzyme mix) together with the promoter containing plasmid pENTR-CMV (Tai et al. supra), resulting in the vectors $2k7_{neo}$-CMV-hB2M and $2k7_{neo}$-CMV-mB2M, respectively.

Lentiviral Transduction of HeLa Cells:

The vector pairs $2k7_{neo}$-CMV-hB2M and pHR-cPPT-CMV-hFcRn-eGFP or $2k7_{neo}$-CMV-mB2M and pHR-cPPT-CMV-mFcRn-eGFP were co-transfected together with VSV-G envelope and gag/pol packaging plasmid into HEK293T cells using calcium chloride transfection (Zufferey et al., supra; Jakobsson et al. (2006) supra). HEK293T culture supernatants containing formed lentiviral particles with FcRn and B2M transgenes respectively were used to sequentially transduce HeLa Cervix adenocarcinoma cells (Cell Line Service) at low passage number. The resulting two stably transduced HeLa cell lines are in the following denoted hFcRn-eGFP (transduced with genes for human FcRn-eGFP and hB2M) and mFcRn-eGFP (transduced with genes for mouse FcRn-eGFP and mB2M).

Alexa647 Labeling of FcRn Binding Z Variants:

The three $His_6$-tagged Z variants Z07918, Z07930 and Z07960 were labeled with ALEXA FLUOR 647 Carboxylic Acid Succinimidyl Ester (Invitrogen cat. no. A20106). Before labeling, buffer was exchanged to 0.2 M carbonate buffer, pH 8.3, using Vivaspin500 centrifugal filter units (10 kDa MWCO, Vivaproducts cat. no. 512-2838) spun at 10,000 g. The labeling was performed in the Vivaspin500 and 1 μl of Alexa647 Succinimidyl Ester dye (40 μg/μl in DMSO corresponding to 1.3× molar excess) was added to 200 μg/25 μl Z variant. The mixes were incubated at RT in the dark for 40 minutes in a wiggling rota mixer. The reaction mixes were subsequently put on ice for 3.5 hours and free dye was removed by washing with 15×100 μl PBS in the Vivaspin500.

Immunofluorescence Staining of Human and Mouse FcRn-eGFP Transfected HeLa-Cells with FcRn Binding Z Variants:

hFcRn-eGFP and mFcRn-eGFP HeLa cells were harvested by trypsination and washed twice in PBS at pH 6.0 before counting. 100,000 cells were pipetted per well of a v-bottomed 96 well plate (Nunc, cat no 277143) and the cells in the plate were subsequently pelleted at 1,700 rpm for 4 min at 4° C. The supernatants were removed and the cells were fixed with 50 μl of 2% formaldehyde (Sigma Aldrich, cat. no. F8775) in PBS at pH 6.0 for 10 min at RT. Cells were thereafter washed with 2×100 μl PBS pH 6.0, saturated with casein (PBSC), and resuspended in PBSC plus 0.1% saponin (AppliChem, cat no A4518.0100) containing 620 nM of Alexa647 labeled $His_6$-tagged Z variants; Z07960, Z07930 and Z07918. Transduced HeLa cells, incubated with buffer alone, were used as control. The cells were incubated for 1 h at 8° C. on a shaker in the dark, washed with 2×100 μl PBSC and resuspended in 180 μl of PBS pH 6.0 plus 1% BSA (fraction V, Merck, cat. no. 1.12018.0100). 10,000 cells/well were analyzed in a Gallios Flow Cytometer (Beckman Coulter) and the data was analyzed using Kaluza software (Beckman Coulter).

Results

Figure 3:
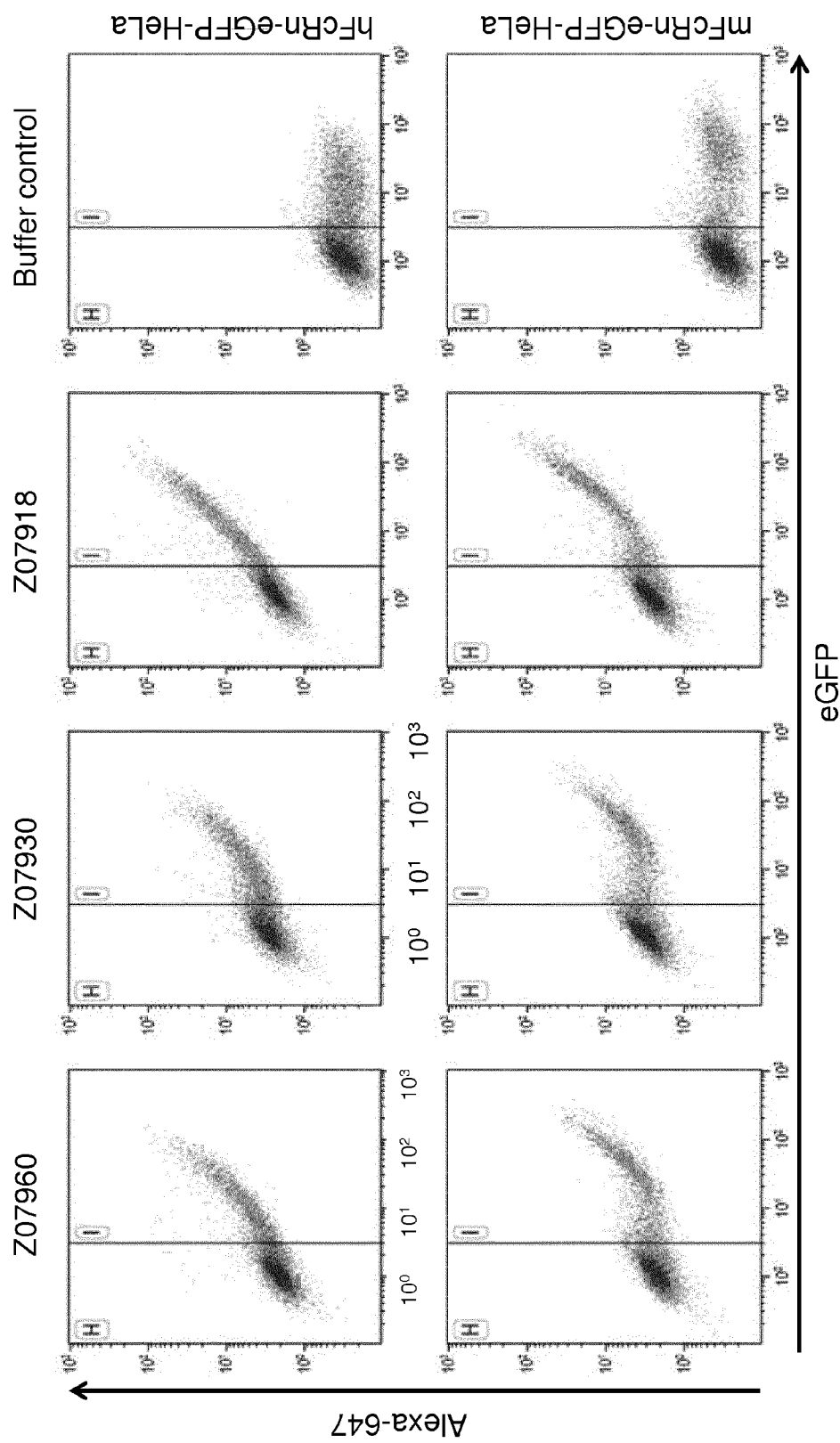
FIG. 3 shows dot plots from a flow cytometry analysis of binding of FcRn binding Z variant to human (upper panel) and mouse (lower panel) FcRn-eGFP HeLa cells, as described in Example 4. Due to heterogeneous expression of FcRn-eGFP by HeLa cells, cells were gated according to FcRn-eGFP expression level. Cells in gate H are considered to be FcRn-eGFP negative and cells in gate I are considered to be positive. Incubation with Alexa647 labeled Z variants resulted in a population positive both for Alexa647 and eGFP, whereas incubation with buffer (buffer control) did not. The figure shows that the three variants Z07960 (SEQ ID NO:710), Z07930 (SEQ ID NO:712) and Z07918 (SEQ ID NO:707) bind to human FcRn and mouse FcRn. The y-axis shows Alexa647 intensity and the x-axis shows eGFP activity.
Figure 4:
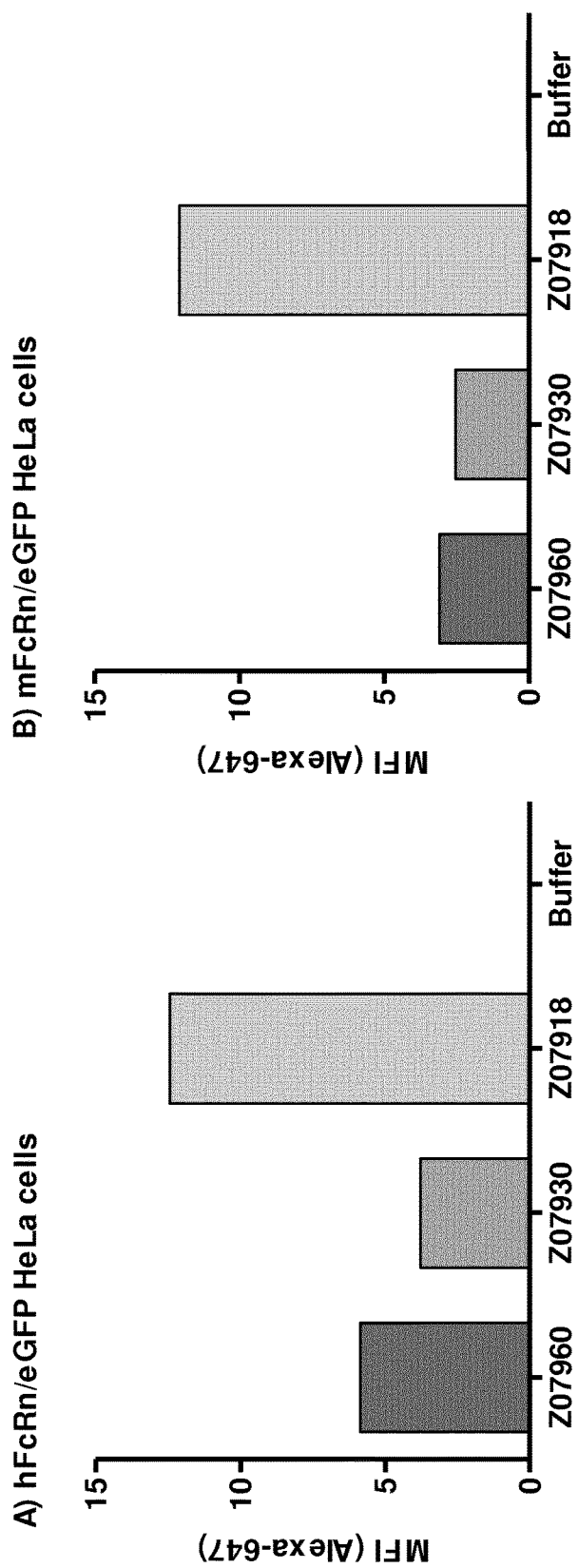
FIG. 4 shows mean fluorescence intensity (MFI) values of Alexa647 labeled Z07960 (SEQ ID NO:710), Z07930 (SEQ ID NO:712) and Z07918 (SEQ ID NO:707), measured in the cell binding assay described in Example 4. Diagram (A) shows MFI from HeLa cells transduced with human FcRn-eGFP and diagram (B) shows MFI from HeLa cells transduced with mouse FcRn-eGFP.

Flow cytometry analysis was utilized to determine whether the FcRn binding Z variants could bind to human and/or mouse FcRn on human or mouse FcRn/eGFP transduced HeLa cells. The experiment was performed at pH 6.0 with Alexa647 labeled Z07960, Z07930 and Z07918 (SEQ ID NO:710, 712 and 707, respectively). Dot plot analysis (y-axis: Alexa647, x-axis: eGFP) showed that the transduced cell population could be divided into FcRn-eGFP negative and positive population (FIG. 3, gate H and I, respectively) indicating heterogeneous expression of the FcRn-eGFP fusion protein by HeLa cells (FIG. 3). Accordingly, the mean fluorescence intensity (MFI) values for Alexa647 in gate I were subtracted by background MFI values of Alexa647 in gate H. The calculated MFI values are presented in FIG. 4. The results show that Z07960, Z07930 and Z07918 are capable of binding HeLa cells displaying human (FIG. 4, Panel A) or murine (FIG. 4, Panel B) FcRn-eGFP.

Example 5

Blocking of IgG Binding to FcRn with the FcRn Binding Z Variant Z07918

In this example, the potential competition of FcRn binding Z variants with IgG for binding to FcRn was investigated in a cell based assay. Such binding will result in blocking of the IgG-FcRn interaction.

Materials and Methods

Blocking of IgG-FcRn Immunofluorescence Staining:

Human or murine FcRn-eGFP transduced HeLa cells were prepared as described in Example 4. Fixed cells were resuspended in 50 μl of a mix of either 100 nM Alexa647-conjugated human or mouse IgG (Jackson laboratories, cat. no. 009-600-003 and 015-600-003, respectively) and 1000, 100, 10, 1 or 0 (buffer control) nM $His_6$-tagged Z07918 diluted in PBS-casein, pH 6.0, plus 0.1% saponin (AppliChem). The cells were incubated for 1 h at 37° C. on a shaker in the dark, washed with 2×100 μl PBS-casein pH 6.0 and re-suspended in 180 μl of PBS, pH 6.0, plus 1% BSA. Data from 10,000 cells/well (except somewhat fewer cells for mouse 100 nM mIgG-Alexa647) were obtained using a Gallios Flow Cytometer (Beckman Coulter) and the data was analyzed using Kaluza software (Beckman Coulter).

Results

Figure 5:
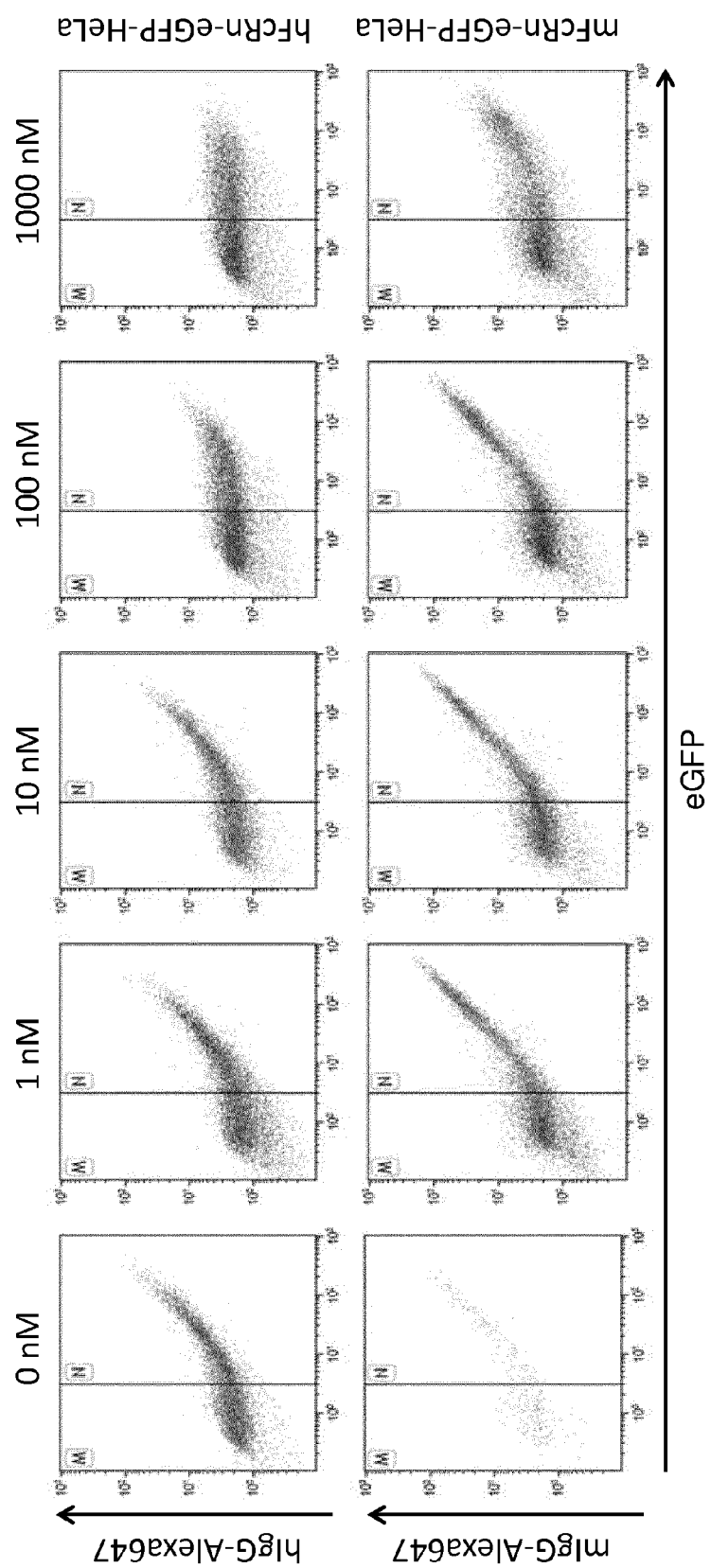
FIG. 5 shows dot plots from flow cytometry analysis of human or mouse IgG Alexa647 binding to human (upper panel) and mouse (lower panel) FcRn-eGFP HeLa cells, as described in Example 5. Due to heterogeneous expression of FcRn-eGFP by HeLa cells, cells were gated according to the abundance of FcRn-eGFP on the cell surface. Cells in gate M are considered to be FcRn-eGFP negative and cells in gate N are considered to be positive. Binding of 100 nM human or mouse IgG-Alexa647 to FcRn transduced HeLa cells are shown in the left panel (0 nM). The figure shows that IgG binding was blocked by $His_6$-tagged Z07918 (SEQ ID NO:707) in a dose dependent manner (1, 10, 100 and 1000 nM). The y-axis shows Alexa647 intensity and the x-axis shows eGFP activity.
Figure 6:
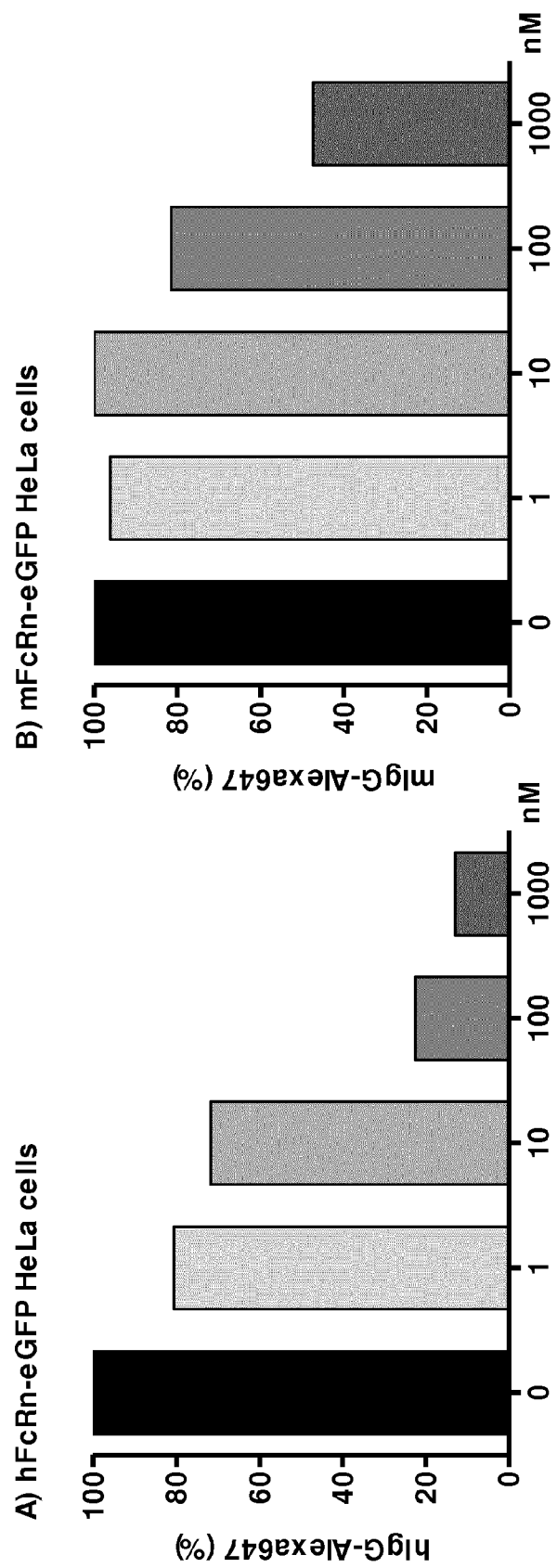
FIG. 6 shows mean fluorescence intensity (MFI) values resulting from FcRn binding of IgG Alexa647 in the presence of different concentrations of $His_6$-tagged Z07918 (SEQ ID NO:707) on (A) human FcRn-eGFP transduced HeLa cells and (B) mouse FcRn-eGFP transduced HeLa cells, as described in Example 5. The figure shows dose dependent blocking of the IgG-FcRn binding by the Z variant.

The experiment was performed to determine if the FcRn binding Z variant Z07918 (SEQ ID NO:707) blocks the IgG-FcRn interaction. Human or murine FcRn-eGFP transduced HeLa cells were incubated with human or mouse Alexa647-conjugated IgG. The binding was blocked with unlabeled Z07918 at different concentrations. Due to the heterogeneous expression of FcRn by the transduced HeLa cells (described in Example 4), the MFI values for Alexa647 in gate N of each sample was subtracted by the corresponding MFI values in gate M (FIG. 5). The percent IgG Alexa647 binding was calculated by dividing the different MFI values with the MFI for the blank control. The results showed that Z07918 effectively blocked hIgG binding to hFcRn (FIG. 6, Panel A) in a dose dependent manner. Furthermore, Z07918 also blocked mIgG binding to mFcRn (FIG. 6, Panel B) although less efficiently compared to hIgG-binding.

Example 6

Pharmacokinetic Study of Three FcRn Binding Z Variants

In this example, the ability of FcRn binding Z variants to prolong serum half-life of a non-specific Z variant was investigated by a pharmacokinetic study performed in mice.

Materials and Methods

Subcloning of Z Variants:

A subset of Z variants (Z07918, Z07960 and Z10193) was submitted to a second subcloning. DNA from the subcloned $His_6$-tagged variants in Example 3 was used as template. First, PCR amplification using suitable primer pairs was performed to create genes encoding Z variants starting with the amino acids AE instead of VD. The mutated Z variants are listed in FIGS. 1A-1NN and were denoted Z11948 (SEQ ID NO:1060), Z11946 (SEQ ID NO:1061) and Z11947 (SEQ ID NO:1062), corresponding to mutated Z07918, Z07960 and Z10193, respectively. Genes encoding the new Z variants were restriction cleaved and ligated into a vector harboring the genes encoding albumin binding variant PP013 (SEQ ID NO:1063) and Z03638 (SEQ ID NO:1064) with spacer sequences resulting in a gene fusion encoding [Z#####]-GAP($G_4S$)$_4$TS-[PP013]-GT($G_4S$)$_4$PR-[Z03638] (SEQ ID NO: 1104) (also denoted "Z#####-PP013-Z03638" or "Z variant in fusion with PP013-Z03638"). The negative control molecule [Z03638]-GAP($G_4S$)$_4$TS-[PP013] (SEQ ID NO: 1105) was subcloned in a similar way by ligating Z03638 into a vector containing a ($G_4S$)$_4$ linker and the sequence for PP013. The subsequent steps for vector transformation into *E. coli* were performed as in Example 3.

Cultivation and Purification:

Z variants in fusion with PP013-Z03638 were produced in *E. coli* as described in Example 3. Approximately 3 g of each cell pellet was re-suspended in 30 ml TST-buffer (25 mM Tris-HCl, 1 mM EDTA, 200 mM NaCl, 0.05% Tween20, pH 8.0) supplemented with BENZONASE (Merck). After cell disruption by sonication and clarification by centrifugation, each supernatant was applied on a gravity flow column with 5 ml agarose immobilized with an anti-ABD ligand (produced in-house). After washing with TST-buffer and 5 mM $NH_4Ac$ buffer, pH 5.5, the Z variants were eluted with 0.1 M HAc. Acetonitrile (ACN) was added to a final concentration of 10% to the eluted fractions from the anti-ABD agarose affinity chromatography purification step and the samples were loaded on a 3 ml Resource 15RPC column (GE Healthcare), previously equilibrated with RPC solvent A (0.1% trifluoroacetic acid (TFA), 10% ACN, 90% water). After column wash with RPC solvent A, bound protein was eluted with a linear gradient 0-50% RPC solvent B (0.1% TFA, 80% ACN, 20% water) during 60 ml. Fractions containing pure Z variant were identified by SDS-PAGE analysis and pooled. After the RPC purification, the buffer of the pools was exchanged to PBS using a HiPrep 26/10 Desalting column (GE Healthcare). Finally, the Z variants were purified on 1 ml EndoTrap red columns (Hyglos, cat. no. 321063) to ensure low endotoxin content.

Protein concentrations, purities and the identity of each purified Z variant were analyzed as described in Example 3.

Biacore Analysis:

Expressed and purified Z variants fused to PP013-Z03638 were assayed against human FcRn at pH 6.0 essentially as described for the kinetic analysis in Example 3. The Z variants and the negative control Z03638-PP013 were injected at 40 nM, 160 nM and 640 nM during 1 minute followed by dissociation for 2.5 minutes and equilibration for 1 minute. Kinetic constants and affinities were determined for the Z variants using the BiaEvaluation software.

Pharmacokinetic Study:

Z11947, Z11946 and Z11948 fused to PP013-Z03638 were administered intravenously (i.v.) to male NMRI mice (Charles River, Germany) at a dose of 92 nmol/kg body weight. Sera from groups of three mice were obtained at 0.08, 6, 18, 78, 120, 168 and 240 hours. The concentration of respective Z variant was determined by ELISA.

ELISA:

Half-area 96-well ELISA plates were coated at 4° C. overnight with 50 μl/well of an Z specific goat antibody (produced in-house) diluted to 4 μg/ml in coating buffer (50 mM sodium carbonate, pH 9.6). The antibody solution was poured off and the wells were blocked with 100 μl of PBSC for 1.5 h at RT. The sera were diluted in PBSC plus 1% mouse serum (matrix) from 1:100 to 1:51,200 in a two-fold dilution series in a dilutions plate. A standard titration for respective Z variant and four quality controls (very low, low, medium and high control) diluted in matrix were included on each plate. 50 μl of the dilutions were transferred per well and the ELISA plates were incubated for 1.5 h at RT. The plates were washed four times with PBST. Bound Z variants were detected with 50 μl/well of rabbit anti-PP013 Ig (produced in-house) diluted to 4 μg/ml in PBSC. The plates were subsequently incubated for 1.5 h at RT followed by washes as described above. HRP conjugated donkey anti-rabbit HRP obtained from Jackson laboratories (cat. no. 711-035-152), diluted 1:20,000 in PBSC, was added and the plates were incubated for 1 hour. After washing as described above, 50 μl of ImmunoPure TMB substrate was added to the wells and the plates were developed according to the manufacturer's recommendations. After 15 minutes of development, the absorbance was measured at 450 nm using a multi-well plate reader (Victor³). The absorbance values were analyzed using GraphPad Prism 5 to determine the concentrations (cubic-spline curve fit) and area under curve (AUC). The concentrations were then plotted as their natural logarithms against time. The resulting curves followed a two compartment model and the terminal half-life was calculated as ln2 divided by the slope based on the last three time points.

Results

Cultivation and Purification:

The three FcRn binding Z variants Z11947, Z11946 and Z11948 (SEQ ID NO:1062, 1061 and 1060), constructed as Z#####-PP013-Z03638, and the negative control Z03638-PP013, were produced in *E. coli*. The amount of purified protein from approximately 3 g bacterial pellets, determined spectrophotometrically by measuring the absorbance at 280 nm, ranged from approximately 10 to 25 mg for the different FcRn binding Z variants. SDS-PAGE analysis of each final protein preparation showed that they predominantly contained respective FcRn binding Z variant. The correct molecular weight of each FcRn binding Z variant was confirmed by LC/MS analysis.

TABLE 6

Kinetic constants and affinities for FcRn at pH 6.0 of Z variants produced as fusions to PP013-Z03638.

| Z variant | SEQ ID NO: | $k_{on}$ ($M^{-1}s^{-1}$) | $k_{off}$ ($s^{-1}$) | $K_D$ (M) |
|---|---|---|---|---|
| Z11948 | 1060 | $7.73 \times 10^5$ | 0.047 | $6.2 \times 10^{-8}$ |
| Z11946 | 1061 | $3.35 \times 10^5$ | 0.275 | $8.2 \times 10^{-7}$ |
| Z11947 | 1062 | $6.54 \times 10^5$ | 0.064 | $9.8 \times 10^{-8}$ |

Figure 7A:
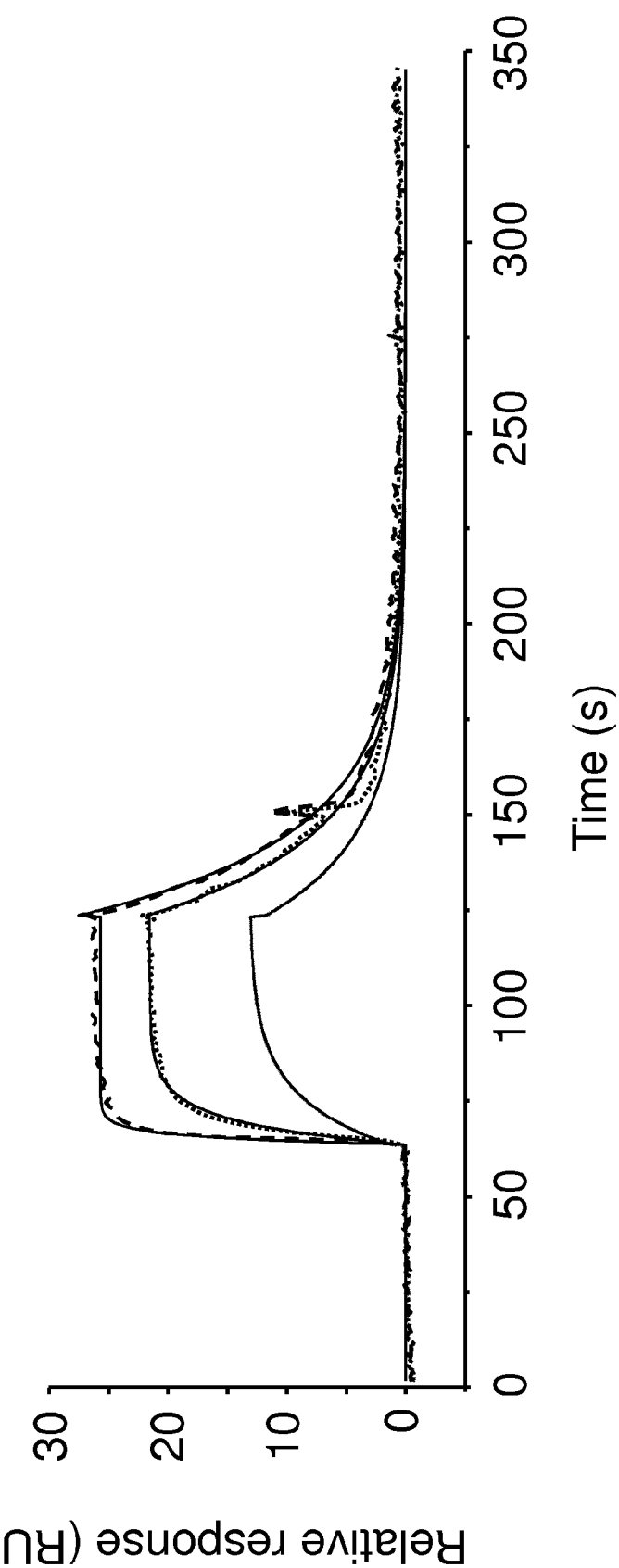
Figure 7C:
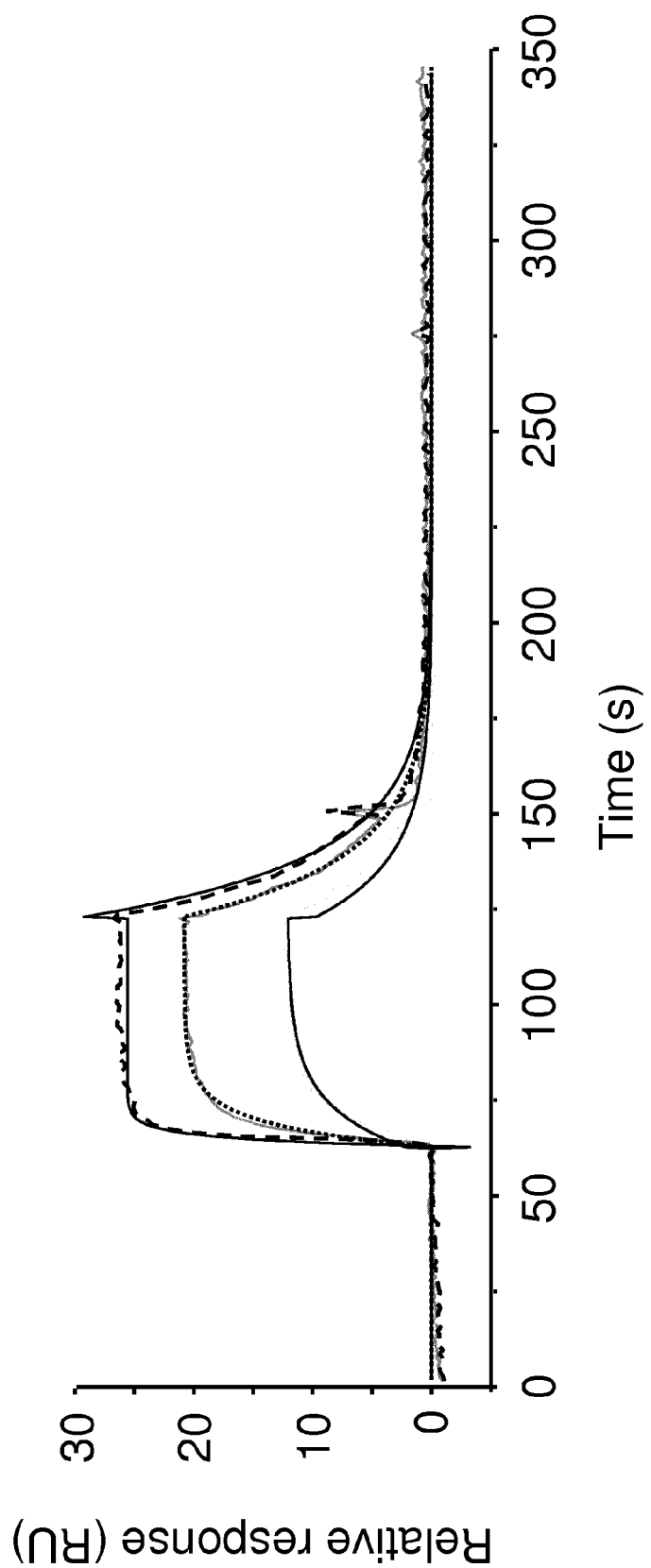
Figure 8:
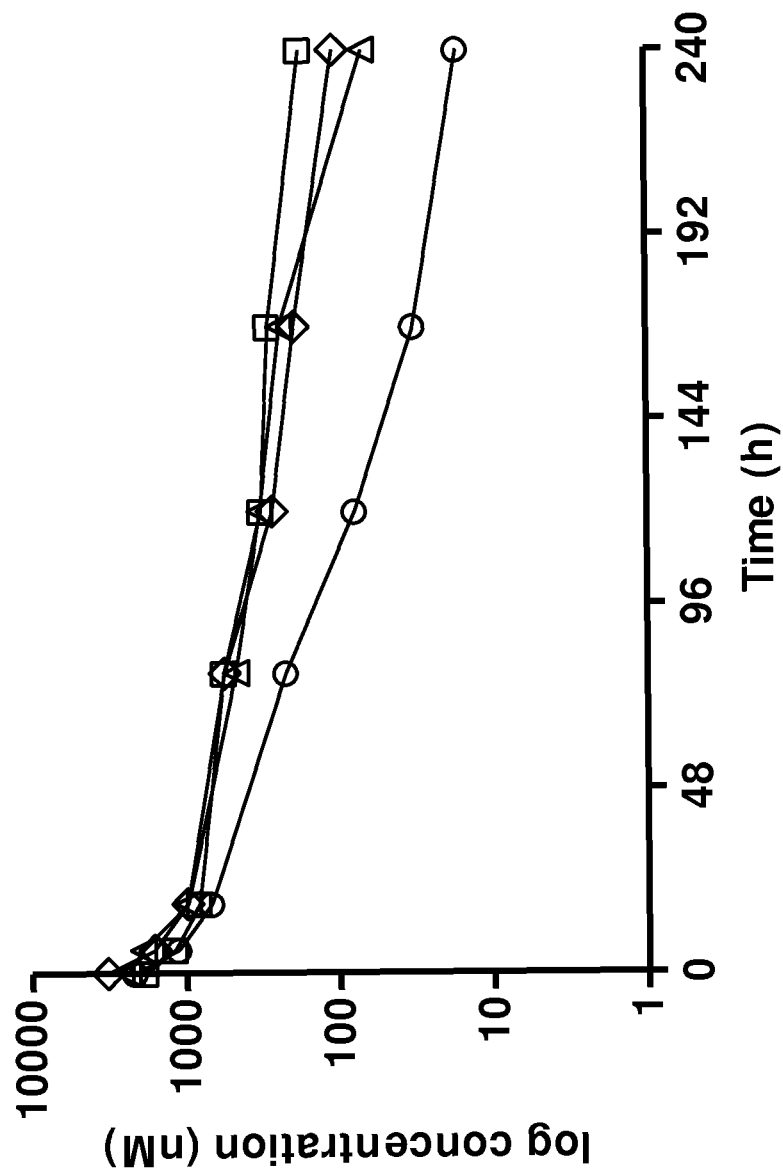
FIG. 8 shows the pharmacokinetic profiles for three FcRn binding Z variants fused to the albumin binding polypeptide PP013 obtained as described in Example 6. The Z variants Z11947 (SEQ ID NO: 1062, open squares), Z11946 (SEQ ID NO:1061, open triangles) and Z11948 (SEQ ID NO:1060, open diamonds) all displayed prolonged half-life compared to the negative control PP013-Z03638 (open circles).

Biacore Analysis:

The binding to FcRn was analyzed for the three PP013-Z03638 fused Z variants. The immobilization level of the surface was 548 RU of human FcRn. The resulting rough kinetic constants and affinities for the target binding at pH 6.0 are displayed in Table 6. Fitted curves are displayed in FIGS. 7A-C. The negative control Z03638-PP013 was negative against FcRn.

Pharmacokinetic Study:

The pharmacokinetic profiles of the above-mentioned constructs of Z variants fused to PP013-Z03638 were compared to the negative control Z03638-PP013 in a mouse pharmacokinetic study. In previous work, e.g. as described in PCT application WO2009/016043, it is shown that ABD fusion proteins have a long half-life in serum, caused by ABD binding to serum albumin. In accordance with the previous results, terminal half-life of ABD-fused Z variant molecule (Z03638-PP013) was approximately 43 hours, which is comparable to half-life of mouse albumin (35 hours). The terminal half-lives of the constructs containing FcRn binding Z variant molecule in addition to ABD were two- to three-fold longer (FIG. 8). The calculated terminal half-lives were 99 hours (Z11947), 69 hours (Z11946) and 58 hours (Z11948), suggesting that FcRn binding of the Z variants contributed to the prolonged half-life.

Example 7

Design and Construction of a Maturation Library of FcRn Binding Z Variants

In this Example, a maturated library was constructed. The library was used for selections of FcRn binding Z variants. Selections from maturated libraries are usually expected to result in binders with increased affinity (Orlova et al., (2006) Cancer Res 66(8):4339-48). In this study, randomized single stranded linkers were generated using split-pool synthesis enabling incorporation of defined codons in desired positions in the synthesis.

Materials and Methods

Library Design:

The library was based on the sixteen sequences of the human FcRn binding Z variants in Table 1 and further described in Examples 2-6. In the new library, 13 variable positions in the Z molecule scaffold were biased towards certain amino acid residues, according to a strategy mainly based on the binding motifs of the Z variants defined in SEQ ID NO:707-722. A DNA linker was generated using split-pool synthesis containing the 147 bp partially randomized helix 1 and 2 of the amino acid sequence: 5'-AA ATA AAT CTC GAG GTA GAT GCC AAA TAC GCC AAA GAA NNN NNN NNN GCG NNN NNN GAG ATC NNN NNN TTA CCT AAC TTA ACC NNN NNN CAA NNN NNN GCC TTC ATC NNN AAA TTA NNN GAT GAC CCA AGC CAG AGC TCA TTA TTT A-3' (SEQ ID NO:1074; randomized codons are illustrated as NNN) flanked by restriction sites XhoI and SacI, was ordered from DNA 2.0 (Menlo Park, Calif., USA). The theoretical distributions of amino acid residues in the new library, including eight variable amino acid positions (9, 10, 11, 13, 14, 24, 32 and 35) and five constant amino acid positions (17, 18, 25, 27 and 28) in the Z molecule scaffold are given in Table 8. The resulting theoretical library size is $5.3\times10^{8}$ variants.

TABLE 7

Design of library for maturation.

| Amino acid position in the Z variant | Randomization (amino acid abbreviations) | No of amino acids | Proportion |
|---|---|---|---|
| 9 | A, D, E, F, H, I, K, L, N, Q, R, S, T, V, W, Y | 16 | 1/16 |
| 10 | A, D, E, F, H, I, K, L, M, N, Q, R, S, T, V, W, Y | 17 | 1/17 |
| 11 | A, D, E, F, H, I, K, L, N, Q, R, S, T, V, W, Y | 16 | 1/16 |
| 13 | A, D, E, F, G, H, I, K, L, N, Q, R, S, T, V, W, Y | 17 | 1/17 |
| 14 | A, F, H (25%), I, K, L, N, Q, R, S, T, V, W, Y | 14 | 3/52, 13/52 (H) |
| 17 | R | 1 | 1 |
| 18 | W | 1 | 1 |
| 24 | F, Y | 2 | 1/2 |
| 25 | D | 1 | 1 |
| 27 | R | 1 | 1 |
| 28 | V | 1 | 1 |
| 32 | A, D, E, F, H, I, K, L, N, Q, R, S, T, V, W, Y | 16 | 1/16 |
| 35 | A, D, E, F, H, I, K, L, N, Q, R, S, T, V, W, Y | 16 | 1/16 |

Library Construction:

The library was amplified using Ampli Taq Gold polymerase (Applied Biosystems, cat. no. 4311816) during 12 cycles of PCR and pooled products were purified with QIAquick PCR Purification Kit (QIAGEN, cat. no. 28106) according to the supplier's recommendations. The purified pool of randomized library fragments was digested with restriction enzymes XhoI and SacI-HF (New England Biolabs, cat. no. R0146L, and cat. no. R3156M) and concentrated using a PCR Purification Kit. Subsequently, the product was subjected to preparative 2.5% agarose (Nuisieve GTC agarose, Cambrex, Invitrogen) gel electrophoresis and purified using QIAGEN gel extraction Kit (QIAGEN, cat. no. 28706) according to the supplier's recommendations.

The phagemid vector pAY02592 (essentially as pAffi1 described in Grönwall et al., supra) was restricted with the same enzymes, purified using phenol/chloroform extraction and ethanol precipitation. The restricted fragments and the restricted vector were ligated in a molar ratio of 5:1 with T4 DNA ligase (Fermentas, cat. no. EL0011) for 2 hours at RT, followed by overnight incubation at 4° C. The ligated DNA was recovered by phenol/chloroform extraction and ethanol precipitation, followed by dissolution in 10 mM Tris-HCl, pH 8.5. Thus, the resulting library in vector pAY02592 encoded Z variants, each fused to an albumin binding domain (ABD) derived from streptococcal protein G.

The ligation reactions (approximately 160 ng DNA/transformation) were electroporated into electrocompetent *E. coli* ER2738 cells (50 μl, Lucigen, Middleton, Wis., USA). Immediately after electroporation, approximately 1 ml of recovery medium (supplied with the ER2738 cells) was added. The transformed cells were incubated at 37° C. for 60 min. Samples were taken for titration and for determination of the number of transformants. The cells were thereafter pooled and cultivated overnight at 37° C. in 1 l of TSB-YE medium, supplemented with 2% glucose, 10 μg/ml tetracycline and 100 μg/ml ampicillin. The cells were pelleted for 7 min at 4,000 g and resuspended in a PBS/glycerol solution (approximately 40% glycerol). The cells were aliquoted and stored at −80° C. Clones from the library of Z variants were sequenced in order to verify the content and to evaluate the outcome of the constructed library vis-à-vis the library design. Sequencing was performed as described in Example 1 and the amino acid distribution was verified.

Preparation of phage stock: Phage stock containing the phagemid library was prepared in a 20 l fermenter (Belach Bioteknik). Cells from a glycerol stock containing the phagemid library were inoculated in 10 l of TSB-YE (Tryptic Soy Broth-Yeast Extract; 30 g/l TSB, 5 g/l yeast extract) supplemented with 1 g/l glucose, 100 mg/l ampicillin and 10 mg/l tetracycline. When the cells reached an optical density at 600 nm (OD600) of 0.6, approximately 1.5 l of the cultivation was infected using a 5× molar excess of M13K07 helper phage. The cells were incubated for 30 min, whereupon the fermenter was filled up to 10 l with complex fermentation medium [2.5 g/l $(NH_4)_2SO_4$; 5.0 g/l yeast extract; 30 g/l tryptone, 2 g/l $K_2HPO_4$; 3 g/l $KH_2PO_4$, 1.25 g/l; $Na_3C_6H_5O_7.2H_2O$; Breox FMT30 antifoaming agent 0.1 ml/l]. The following components were added: 10 ml carbenicillin 25 mg/ml; 5 ml kanamycin 50 mg/ml; 1 ml 1 M isopropyl-β-D-1-thiogalactopyranoside (IPTG); 17.5 ml/l of 300 g/l $MgSO_4$, and 5 ml of a trace element solution [35 g/l $FeCl_3.6H_2O$; 10.56 g/l $ZnSO_4.7H_2O$; 2.64 g/l $CuSO_4.5H_2O$; 13.2 g/l $MnSO_4.H_2O$; 13.84 g/l $CaCl_2.2H_2O$, dissolved in 1.2 M HCl]. A glucose limited fed-batch cultivation was started where a 600 g/l glucose solution was fed to the reactor (3.5 g/h in the start, 37.5 g/h after 20 h and until the end of the cultivation). pH was controlled at pH 7 through the automatic addition of 25% $NH_4OH$, air was supplemented (5 l/min), and the stirrer was set at 500 rpm. After 24 h of fed-batch cultivation the OD600 was 33.2. The cells in the cultivation were pelleted by centrifugation at 15,900 g. The phage particles were precipitated from the supernatant twice in PEG/NaCl, filtered and dissolved in PBS and glycerol as in Example 2. Phage stocks were stored at −80° C. until use in selection.

Results

Library Construction:

The new library was designed based on a set of 16 FcRn binding Z variants with verified binding properties (Example 2-6). The theoretical size of the designed library was 5.3× $10^8$ Z variants. The actual size of the library, determined by titration after transformation to E. coli ER2738 cells, was 4.5×$10^9$ transformants.

The library quality was tested by sequencing of 96 transformants and by comparing their actual sequences with the theoretical design. The contents of the actual library compared to the designed library were shown to be satisfying. A maturated library of potential binders to FcRn was thus successfully constructed.

Example 8

Selection and Screening of Z Variants from a Maturated Library

Materials and Methods

Phage Display Selection of Matured FcRn Binding Z Variants:

The target proteins human FcRn (Biorbyt, cat. no. orb84388) and murine FcRn (Biorbyt, cat. no. orb99076) were biotinylated essentially as described in Example 2 using biotin at 10× molar excess. Phage display selections, using the new library of Z variant molecules described in Example 7, were performed in four cycles against human FcRn or murine FcRn essentially as in Example 2 but with the following exceptions. Selection buffers were 0.1% PCTG buffer, pH 5.5 (McIlvaines phosphate-citrate buffer, pH 5.5, supplemented with 0.1 Tween-20 and 0.1% gelatin) or 0.1% PCTG buffer, pH 7.4, (McIlvaines phosphate-citrate buffer, pH 7.4, supplemented with 0.1% Tween-20 and 0.1% gelatin) respectively. Prior to selection, HSA was added to the selection buffers to a final concentration of 1.5 μM. All tubes and beads used in the selection were pre-blocked with either of the two different selections buffers. A pre-selection step, by incubation of phage stock with SA-beads for 45 min, was performed in cycle 1. For capture of phage-target complexes, 1 mg beads per 1.1 μg biotinylated human FcRn or 1.6 μg biotinylated murine FcRn was used. Washes were performed with 0.1% PCT buffer pH 5.5 or pH 7.4 except for tracks 2-1-2-1 and 2-1-2-2 where 0.1% PCT supplemented with 25 nM IgG (HERCEPTIN) or 10 nM IgG, respectively, was used as outlined in Table 7.

The five tracks (1-5) in cycle 1 were divided in the second to fourth cycles, resulting in totally seven tracks (1-1 to 5-1) in cycle 2, eleven tracks (1-1-1 to 5-1-1) in cycle 3 and fourteen tracks (1-1-1-1 to 5-1-1-1) in cycle 4. The bound phage particles were eluted as described in Example 2.

An overview of the selection strategy, describing an increased stringency in subsequent cycles, using a lowered target concentration and an increased number of washes, is shown in Table 8.

TABLE 8

Overview of the maturation selection data.

| Cycle | Selection track | Phage stock from library or selection track | Target species | Target conc. (nM) | Selection pH | Wash pH | Number of washes |
|---|---|---|---|---|---|---|---|
| 1 | 1 | Zlib006FcRn.I | human | 100 | 7.4 | 7.4 | 2 |
| 1 | 2 | Zlib006FcRn.I | human | 100 | 7.4 | 5.5 | 2 |
| 1 | 3 | Zlib006FcRn.I | human | 25 | 5.5 | 5.5 | 4 |
| 1 | 4 | Zlib006FcRn.I | murine | 100 | 7.4 | 7.4 | 2 |
| 1 | 5 | Zlib006FcRn.I | murine | 100 | 5.5 | 5.5 | 2 |
| 2 | 1-1 | 1 | human | 50 | 7.4 | 7.4 | 4 |
| 2 | 2-1 | 2 | human | 50 | 7.4 | 5.5 | 4 |
| 2 | 2-2 | 2 | human | 25 | 5.5 | 7.4 | 6 |
| 2 | 3-1 | 3 | human | 5 | 5.5 | 7.4 | 4 |
| 2 | 3-2 | 3 | human | 5 | 5.5 | 5.5 | 8 |
| 2 | 4-1 | 4 | murine | 50 | 7.4 | 5.5 | 2 |
| 2 | 5-1 | 5 | murine | 100 | 5.5 | 5.5 | 2 |
| 3 | 1-1-1 | 1-1 | human | 10 | 7.4 | 7.4 | 8 |
| 3 | 1-1-2 | 1-1 | human | 5 | 5.5 | 7.4 | 8 |
| 3 | 2-1-1 | 2-1 | human | 10 | 7.4 | 5.5 | 8 |
| 3 | 2-1-2 | 2-1 | human | 5 | 7.4 | 5.5 | 12 |

TABLE 8-continued

Overview of the maturation selection data.

| Cycle | Selection track | Phage stock from library or selection track | Target species | Target conc. (nM) | Selection pH | Wash pH | Number of washes |
|---|---|---|---|---|---|---|---|
| 3 | 2-2-1 | 2-2 | human | 10 | 7.4 | 5.5 | 12 |
| 3 | 2-2-2 | 2-2 | human | 5 | 7.4 | 5.5 | 15 |
| 3 | 3-1-1 | 3-1 | human | 1 | 5.5 | 7.4 | 8 |
| 3 | 3-2-1 | 3-2 | human | 0.5 | 5.5 | 5.5 | 12 |
| 3 | 3-2-2 | 3-2 | human | 0.25 | 5.5 | 5.5 | 16 |
| 3 | 4-1-1 | 4-1 | murine | 10 | 7.4 | 5.5 | 6 |
| 3 | 5-1-1 | 5-1 | murine | 5 | 5.5 | 5.5 | 8 |
| 4 | 1-1-1-1 | 1-1-1 | human | 1 | 7.4 | 7.4 | 12 |
| 4 | 1-1-1-2 | 1-1-1 | human | 0.25 | 7.4 | 7.4 | 15 |
| 4 | 1-1-2-1 | 1-1-2 | human | 0.5 | 7.4 | 5.5 | 15 |
| 4 | 1-1-2-2 | 1-1-2 | human | 0.1 | 5.5 | 7.4 | 15 |
| 4 | 2-1-1-1 | 2-1-1 | human | 1 | 7.4 | 5.5 | 15 |
| 4 | 2-1-1-2 | 2-1-1 | human | 0.5 | 7.4 | 5.5 | 15 |
| 4 | 2-1-2-1 | 2-1-2 | human | 0.25 | 7.4 | 5.5 | 20 (+IgG) |
| 4 | 2-1-2-2 | 2-1-2 | human | 0.1 | 7.4 | 5.5 | 20 (+IgG) |
| 4 | 2-2-1-1 | 2-2-1 and 2-2-2 | human | 0.5 | 5.5 | 7.4 | 15 |
| 4 | 2-2-2-1 | 2-2-1 and 2-2-2 | human | 0.5 | 7.4 | 5.5 | 20 |
| 4 | 3-1-1-1 | 3-1-1 | human | 1 | 5.5 | 7.4 | 12 |
| 4 | 3-2-1-1 | 3-2-1 and 3-2-2 | human | 0.5 | 5.5 | 5.5 | 16 |
| 4 | 4-1-1-1 | 4-1-1 | murine | 1 | 7.4 | 5.5 | 12 |
| 4 | 5-1-1-1 | 5-1-1 | murine | 0.5 | 5.5 | 5.5 | 15 |

Amplification of Phage Particles:

Amplification of phage particles between selection cycle 1 and 2 was performed essentially as described in Example 2, with the following exceptions. E. coli ER2738 was used for phage amplification and M13K07 helper phage was used in 5× excess. The amplification of phage particles between the selection cycles 2 and 4 was done by performing infection of bacteria in solution as follows. After infection of log phase E. coli ER2738 with phage particles, TSB supplemented with 2% glucose, 10 μg/ml tetracycline and 100 μg/ml ampicillin was added, followed by incubation with rotation for 30 min at 37° C. Thereafter, the bacteria were infected with M13K07 helper phage in 5× excess. The infected bacteria were pelleted by centrifugation, re-suspended in TSB-YE medium supplemented with 100 μM IPTG, 25 μg/ml kanamycin and 100 μg/ml ampicillin, and grown overnight at 30° C. The overnight cultures were pelleted in a centrifuge, and phage particles in the supernatant were precipitated twice with PEG/NaCl buffer. Finally, the phage particles were re-suspended in selection buffer before entering the next selection cycle.

In the final selection cycle, log phase bacteria were infected with eluate and diluted before spreading onto TBAB plates (30 g/l tryptose blood agar base, Oxoid cat. no. CMO233B) supplemented with 0.2 g/l ampicillin in order to form single colonies to be used in ELISA screening.

Sequencing of Potential Binders:

Individual clones from the different selection tracks were picked for sequencing. All clones run in the ELISA screening were sequenced. Amplification of gene fragments and sequence analysis of gene fragments were performed essentially as described in Example 2.

ELISA Screening of Z Variants:

Single colonies containing Z variants (expressed as Z variant ABD fusion proteins as described in Example 2) were randomly picked from the selected clones of the FcRn maturated library and grown in 1 ml cultivations essentially as described in Example 2. Preparation of the periplasmic supernatants was performed as in Example 2 with eight freeze thawing cycles and the periplasmic fractions were used undiluted in the ELISA screening. ELISA screenings were performed at both pH 6.0 and pH 7.4 essentially as described in Example 2 using biotinylated human FcRn at a concentration of 2 nM in each well. The periplasmic fraction of the primary FcRn binder Z10193 (SEQ ID NO:708; assayed in above experiments) was used as a positive control. Periplasm containing the ABD moiety only was used as a negative control.

ELISA $K_D$ Analysis of FcRn Binding Z Variants:

A selection of FcRn binders was subjected to an analysis of the response against a dilution series of biotinylated human FcRn using ELISA at both pH 6.0 and pH 7.4 as described above. Biotinylated human FcRn was added at a concentration of 30 nM and diluted stepwise 1:3 down to 14 μM. As a background control, all Z variants were also assayed with no target protein added. Periplasm samples containing the primary FcRn binder Z07918 (SEQ ID.NO: 707) was included and analyzed as a positive control. Periplasm containing the ABD moiety only was used as a negative control. Data were analyzed using GraphPad Prism 5 and non-linear regression and $K_D$ values (the half maximal effective concentration) were calculated.

Results

Phage Display Selection of Maturated FcRn Binding Z Variants:

Selection was performed in totally 14 parallel tracks containing four cycles each. The different selection tracks differed in target concentration, target type (human FcRn or murine FcRn), selection time, and wash conditions.

Sequencing of Potential Binders:

Randomly picked clones were sequenced. Each individual Z variant was given an identification number, Z#####, as described in Example 2. In total, 445 new unique Z variant molecules were identified.

The amino acid sequences of the 58 amino acid residues long Z variants are listed in FIGS. 1A-1NN and in the sequence listing as SEQ ID NO:723-1058. The deduced FcRn binding motifs of these Z variants are listed in FIGS.

1A-1NN and in the sequence listing as SEQ ID NO:17-352. The amino acid sequences of the 49 amino acid residues long polypeptides predicted to constitute the complete three-helix bundle within each of these Z variants are listed in FIG. 1 and in the sequence listing as SEQ ID NO:370-705.

ELISA Screening of Z Variants:

Clones obtained after four selection cycles were produced in 96-well plates and screened for FcRn binding activity using ELISA. All randomly picked clones were analyzed. At pH 6.0, 333 of the 445 unique Z variants were found to give a response of 0.3 AU or higher (corresponding to at least 3× the negative control) against human FcRn at a concentration of 2 nM. At pH 7.4, 278 of the 445 unique Z variants were found to give a response of 0.3 AU or higher (corresponding to at least 3× the negative control) against human FcRn at a concentration of 2 nM. Clones with a positive signal against human FcRn were found in all tracks (including those with murine target) except 1-1-1-1. The negative controls had absorbances of 0.070-0.096 AU (pH 6.0) and 0.060-0.112 AU (pH 7.4), respectively. The average response of the blank controls was 0.070 AU (pH 6.0) and 0.062 (pH 7.4).

ELISA $K_D$ Analysis of FcRn Binding Z Variants:

A subset of Z variants was selected based on the result in the ELISA experiment described above (highest ELISA value at pH 6.0 and/or pH 7.4) and subjected to a target titration in ELISA format. Periplasm samples were incubated with a serial dilution of biotinylated human FcRn. A periplasm sample with the primary binder Z07918 (SEQ ID NO:707) was also assayed as a positive control. Obtained values were analyzed and their respective $K_D$ values were calculated (Table 9).

TABLE 9

Calculated $K_D$ values from ELISA titration analysis of Z-ABD variants from the maturation.

| Z variant | SEQ ID NO: | $K_D$ pH 6.0 (M) | $K_D$ pH 7.4 (M) |
|---|---|---|---|
| Z13573 | 723 | $1.1 \times 10^{-9}$ | $3.8 \times 10^{-9}$ |
| Z13574 | 724 | $1.2 \times 10^{-9}$ | $5.0 \times 10^{-9}$ |
| Z13577 | 725 | $9.9 \times 10^{-10}$ | $1.4 \times 10^{-9}$ |
| Z13578 | 726 | $1.0 \times 10^{-9}$ | $2.5 \times 10^{-9}$ |
| Z13579 | 727 | $1.2 \times 10^{-9}$ | $5.3 \times 10^{-9}$ |
| Z13581 | 728 | $1.1 \times 10^{-9}$ | $3.3 \times 10^{-9}$ |
| Z13583 | 729 | $8.0 \times 10^{-10}$ | $1.5 \times 10^{-9}$ |
| Z13585 | 730 | $1.2 \times 10^{-9}$ | $1.7 \times 10^{-9}$ |
| Z13586 | 731 | $1.2 \times 10^{-9}$ | $2.3 \times 10^{-9}$ |
| Z13587 | 732 | $1.4 \times 10^{-9}$ | $6.9 \times 10^{-9}$ |
| Z13588 | 733 | $1.0 \times 10^{-9}$ | $2.3 \times 10^{-9}$ |
| Z13592 | 734 | $9.5 \times 10^{-10}$ | $1.8 \times 10^{-9}$ |
| Z13594 | 735 | $1.3 \times 10^{-9}$ | $6.3 \times 10^{-9}$ |
| Z13596 | 736 | $1.5 \times 10^{-9}$ | $3.6 \times 10^{-9}$ |
| Z13597 | 737 | $1.4 \times 10^{-9}$ | $6.0 \times 10^{-9}$ |
| Z13598 | 738 | $1.1 \times 10^{-9}$ | $1.7 \times 10^{-9}$ |
| Z13600 | 739 | $1.4 \times 10^{-9}$ | $4.0 \times 10^{-9}$ |
| Z13604 | 740 | $1.3 \times 10^{-9}$ | $4.1 \times 10^{-9}$ |
| Z13605 | 741 | $1.3 \times 10^{-9}$ | $3.8 \times 10^{-9}$ |
| Z13609 | 742 | $1.3 \times 10^{-9}$ | $2.7 \times 10^{-9}$ |
| Z13611 | 743 | $1.3 \times 10^{-9}$ | $2.5 \times 10^{-9}$ |
| Z13612 | 744 | $1.2 \times 10^{-9}$ | $8.6 \times 10^{-9}$ |
| Z13613 | 745 | $1.2 \times 10^{-9}$ | $4.3 \times 10^{-9}$ |
| Z13615 | 746 | $1.2 \times 10^{-9}$ | $3.1 \times 10^{-9}$ |
| Z13616 | 747 | $9.6 \times 10^{-10}$ | $1.7 \times 10^{-9}$ |
| Z13617 | 748 | $1.2 \times 10^{-9}$ | $1.9 \times 10^{-9}$ |
| Z13620 | 749 | $1.4 \times 10^{-9}$ | $3.3 \times 10^{-9}$ |
| Z13621 | 750 | $8.6 \times 10^{-10}$ | $1.4 \times 10^{-9}$ |
| Z13622 | 751 | $1.1 \times 10^{-9}$ | $2.1 \times 10^{-9}$ |
| Z13624 | 752 | $1.3 \times 10^{-9}$ | $3.4 \times 10^{-9}$ |
| Z13625 | 753 | $1.3 \times 10^{-9}$ | $2.8 \times 10^{-9}$ |
| Z13626 | 754 | $1.2 \times 10^{-9}$ | $2.7 \times 10^{-9}$ |
| Z13627 | 755 | $1.2 \times 10^{-9}$ | $2.9 \times 10^{-9}$ |

TABLE 9-continued

Calculated $K_D$ values from ELISA titration analysis of Z-ABD variants from the maturation.

| Z variant | SEQ ID NO: | $K_D$ pH 6.0 (M) | $K_D$ pH 7.4 (M) |
|---|---|---|---|
| Z13628 | 756 | $1.3 \times 10^{-9}$ | $5.5 \times 10^{-9}$ |
| Z13629 | 757 | $1.2 \times 10^{-9}$ | $8.5 \times 10^{-9}$ |
| Z13633 | 758 | $1.5 \times 10^{-9}$ | $6.2 \times 10^{-9}$ |
| Z13634 | 759 | $1.1 \times 10^{-9}$ | $2.3 \times 10^{-9}$ |
| Z13635 | 760 | $1.0 \times 10^{-9}$ | $1.7 \times 10^{-9}$ |
| Z13637 | 761 | $1.3 \times 10^{-9}$ | $4.8 \times 10^{-9}$ |
| Z13638 | 762 | $1.2 \times 10^{-9}$ | $2.9 \times 10^{-9}$ |
| Z13639 | 763 | $1.3 \times 10^{-9}$ | $3.0 \times 10^{-9}$ |
| Z13640 | 764 | $1.1 \times 10^{-9}$ | $1.9 \times 10^{-9}$ |
| Z13641 | 765 | $1.1 \times 10^{-9}$ | $1.8 \times 10^{-9}$ |
| Z13644 | 766 | $1.3 \times 10^{-9}$ | $2.8 \times 10^{-9}$ |
| Z13645 | 767 | $1.2 \times 10^{-9}$ | $2.5 \times 10^{-9}$ |
| Z13648 | 768 | $1.6 \times 10^{-9}$ | $3.3 \times 10^{-9}$ |
| Z13651 | 769 | $1.2 \times 10^{-9}$ | $2.7 \times 10^{-9}$ |
| Z13652 | 770 | $1.4 \times 10^{-9}$ | $2.9 \times 10^{-9}$ |
| Z13654 | 771 | $9.5 \times 10^{-10}$ | $2.9 \times 10^{-9}$ |
| Z13655 | 772 | $1.1 \times 10^{-9}$ | $2.4 \times 10^{-9}$ |
| Z13656 | 773 | $1.1 \times 10^{-9}$ | $3.7 \times 10^{-9}$ |
| Z13657 | 774 | $2.1 \times 10^{-9}$ | $3.9 \times 10^{-9}$ |
| Z13659 | 775 | $2.2 \times 10^{-9}$ | $3.1 \times 10^{-9}$ |
| Z13663 | 776 | $9.3 \times 10^{-10}$ | $1.5 \times 10^{-9}$ |
| Z13664 | 777 | $2.4 \times 10^{-9}$ | $4.2 \times 10^{-9}$ |
| Z13667 | 778 | $1.2 \times 10^{-9}$ | $2.3 \times 10^{-9}$ |
| Z13669 | 779 | $9.2 \times 10^{-10}$ | $1.7 \times 10^{-9}$ |
| Z13672 | 780 | $2.5 \times 10^{-9}$ | $5.6 \times 10^{-9}$ |
| Z13674 | 781 | $9.2 \times 10^{-10}$ | $1.3 \times 10^{-9}$ |
| Z13675 | 782 | $9.6 \times 10^{-10}$ | $2.2 \times 10^{-9}$ |
| Z13676 | 783 | $9.4 \times 10^{-10}$ | $3.1 \times 10^{-9}$ |
| Z13678 | 784 | $2.0 \times 10^{-9}$ | $3.3 \times 10^{-9}$ |
| Z13684 | 785 | $1.0 \times 10^{-9}$ | $2.2 \times 10^{-9}$ |
| Z13688 | 786 | $1.3 \times 10^{-9}$ | $2.1 \times 10^{-9}$ |
| Z13691 | 787 | $1.8 \times 10^{-9}$ | $2.7 \times 10^{-9}$ |
| Z13692 | 788 | $1.3 \times 10^{-9}$ | $3.7 \times 10^{-9}$ |
| Z13694 | 789 | $9.8 \times 10^{-10}$ | $3.6 \times 10^{-9}$ |
| Z13695 | 790 | $1.8 \times 10^{-9}$ | $5.3 \times 10^{-9}$ |
| Z13697 | 791 | $1.2 \times 10^{-9}$ | $2.4 \times 10^{-9}$ |
| Z13706 | 792 | $2.0 \times 10^{-9}$ | $6.4 \times 10^{-9}$ |
| Z13708 | 793 | $1.9 \times 10^{-9}$ | $4.4 \times 10^{-9}$ |
| Z13710 | 794 | $1.6 \times 10^{-9}$ | $2.6 \times 10^{-9}$ |
| Z13711 | 795 | $2.1 \times 10^{-9}$ | $4.9 \times 10^{-9}$ |
| Z13714 | 796 | $2.1 \times 10^{-9}$ | $6.0 \times 10^{-9}$ |
| Z13716 | 797 | $1.8 \times 10^{-9}$ | $5.8 \times 10^{-9}$ |
| Z13719 | 798 | $2.6 \times 10^{-9}$ | $7.3 \times 10^{-9}$ |
| Z13720 | 799 | $2.5 \times 10^{-9}$ | $4.5 \times 10^{-7}$ |
| Z13721 | 800 | $1.9 \times 10^{-9}$ | $2.9 \times 10^{-9}$ |
| Z13725 | 801 | $1.8 \times 10^{-9}$ | $4.9 \times 10^{-9}$ |
| Z13727 | 802 | $2.1 \times 10^{-9}$ | $5.9 \times 10^{-9}$ |
| Z13728 | 803 | $2.6 \times 10^{-9}$ | $6.7 \times 10^{-9}$ |
| Z13732 | 804 | $2.1 \times 10^{-9}$ | $9.4 \times 10^{-9}$ |
| Z13735 | 805 | $1.6 \times 10^{-9}$ | $9.1 \times 10^{-9}$ |
| Z13736 | 806 | $1.7 \times 10^{-9}$ | $3.0 \times 10^{-9}$ |
| Z13740 | 807 | $2.0 \times 10^{-9}$ | $5.0 \times 10^{-9}$ |
| Z13742 | 808 | $2.4 \times 10^{-9}$ | $7.6 \times 10^{-9}$ |
| Z13747 | 809 | $1.3 \times 10^{-9}$ | $2.3 \times 10^{-9}$ |
| Z13749 | 810 | $2.8 \times 10^{-9}$ | $1.2 \times 10^{-8}$ |
| Z13750 | 811 | $2.7 \times 10^{-9}$ | $8.4 \times 10^{-9}$ |
| Z13751 | 812 | $2.0 \times 10^{-9}$ | $3.8 \times 10^{-9}$ |
| Z13752 | 813 | $2.0 \times 10^{-9}$ | $5.8 \times 10^{-9}$ |
| Z13758 | 814 | $1.9 \times 10^{-9}$ | $6.5 \times 10^{-9}$ |
| Z13759 | 815 | $2.1 \times 10^{-9}$ | $5.6 \times 10^{-9}$ |
| Z13760 | 816 | $2.1 \times 10^{-9}$ | $5.8 \times 10^{-9}$ |
| Z13761 | 817 | $1.9 \times 10^{-9}$ | $3.7 \times 10^{-9}$ |
| Z13771 | 818 | $1.5 \times 10^{-9}$ | $2.0 \times 10^{-9}$ |
| Z13773 | 819 | $2.5 \times 10^{-9}$ | $4.9 \times 10^{-9}$ |
| Z13776 | 820 | $2.2 \times 10^{-9}$ | $5.5 \times 10^{-9}$ |
| Z13777 | 821 | $2.4 \times 10^{-9}$ | $4.6 \times 10^{-9}$ |
| Z13780 | 822 | $2.1 \times 10^{-9}$ | $4.0 \times 10^{-9}$ |
| Z13782 | 823 | $2.2 \times 10^{-9}$ | $4.2 \times 10^{-9}$ |
| Z13783 | 824 | $1.4 \times 10^{-9}$ | $2.2 \times 10^{-9}$ |
| Z13786 | 825 | $2.3 \times 10^{-9}$ | $4.7 \times 10^{-9}$ |
| Z13792 | 826 | $2.0 \times 10^{-9}$ | $2.9 \times 10^{-9}$ |
| Z13796 | 827 | $2.3 \times 10^{-9}$ | $4.2 \times 10^{-9}$ |
| Z13799 | 828 | $1.9 \times 10^{-9}$ | $5.6 \times 10^{-9}$ |

TABLE 9-continued

Calculated $K_D$ values from ELISA titration analysis of Z-ABD variants from the maturation.

| Z variant | SEQ ID NO: | $K_D$ pH 6.0 (M) | $K_D$ pH 7.4 (M) |
|---|---|---|---|
| Z13806 | 829 | $1.6 \times 10^{-9}$ | $3.1 \times 10^{-9}$ |
| Z13808 | 830 | $2.4 \times 10^{-9}$ | $5.5 \times 10^{-9}$ |
| Z13811 | 831 | $2.0 \times 10^{-9}$ | $3.1 \times 10^{-9}$ |
| Z13812 | 832 | $2.3 \times 10^{-9}$ | $1.1 \times 10^{-8}$ |
| Z13823 | 833 | $2.9 \times 10^{-9}$ | $3.8 \times 10^{-9}$ |
| Z13824 | 834 | $1.9 \times 10^{-9}$ | $3.8 \times 10^{-9}$ |
| Z13838 | 835 | $2.6 \times 10^{-9}$ | $5.4 \times 10^{-9}$ |
| Z13840 | 836 | $2.2 \times 10^{-9}$ | $4.1 \times 10^{-9}$ |
| Z13842 | 837 | $2.2 \times 10^{-9}$ | $5.5 \times 10^{-9}$ |
| Z13845 | 838 | $2.6 \times 10^{-9}$ | $4.2 \times 10^{-9}$ |
| Z13846 | 839 | $2.3 \times 10^{-9}$ | $4.3 \times 10^{-9}$ |
| Z13848 | 840 | $2.1 \times 10^{-9}$ | $3.1 \times 10^{-9}$ |
| Z13849 | 841 | $2.1 \times 10^{-9}$ | $3.0 \times 10^{-9}$ |
| Z13860 | 842 | $2.3 \times 10^{-9}$ | $8.7 \times 10^{-9}$ |
| Z13865 | 843 | $2.5 \times 10^{-9}$ | $5.6 \times 10^{-9}$ |
| Z13866 | 844 | $2.0 \times 10^{-9}$ | $2.8 \times 10^{-9}$ |
| Z13875 | 845 | $2.0 \times 10^{-9}$ | $3.4 \times 10^{-9}$ |
| Z13879 | 846 | $2.1 \times 10^{-9}$ | $3.0 \times 10^{-9}$ |

Example 9

Production and Characterization of Z Variants from a Maturated Library

In this Example, twelve Z variants were produced in *E. coli*, purified and assayed for binding to FcRn as well as for inhibition of IgG binding to FcRn.

Materials and Methods

Subcloning of Z Variants into Expression Vectors:

The DNA of twelve FcRn binding Z variants (Z13577 (SEQ ID NO:725), Z13578 (SEQ ID NO:726), Z13583 (SEQ ID NO:729), Z13592 (SEQ ID NO:734), Z13616 (SEQ ID NO:747), Z13621 (SEQ ID NO:750), Z13654 (SEQ ID NO:771), Z13663 (SEQ ID NO:776), Z13669 (SEQ ID NO:779), Z13674 (SEQ ID NO:781), Z13675 (SEQ ID NO:782) and Z13676 (SEQ ID NO:783)) were amplified from the library vector pAY02592. The subcloning was performed as described in Example 3. The Z gene fragments were subcloned into the expression vector pAY01448 resulting in the encoded sequence MGSSHHH-HHHLQ-[Z#####]-VD (SEQ ID NO: 1106).

Production of Z Variants:

Cultivation and purification of the His$_6$-tagged Z variants was performed essentially as described in Example 3.

Biacore Binding and Kinetic Analyses:

The interaction of FcRn binding His$_6$-tagged Z variants with human FcRn was analyzed in a Biacore 2000 instrument essentially as described in Example 3. Human FcRn purchased from Biorbyt (cat. no. orb84388) was used as target protein. The analytes were injected during 2 minutes at 30 µl/min. The dissociation phase was 4 minutes and the equilibration time between the analyte injections was 30 minutes.

In one experiment, the Z variants were injected at pH 6.0 followed by dissociation in buffers of pH 6.0 or pH 7.4, respectively, using the co-inject procedure. The concentration of the Z variants was 100 nM.

In another experiment, approximate kinetic constants ($k_{on}$ and $k_{off}$) and affinities ($K_D$) were determined for a subset of Z variants. Injected concentrations were 540 nM, 180 nM, 60 nM, 20 nM and 6.7 nM.

AlphaLISA Blocking Assay:

The potential of Z variants to inhibit binding of IgG to FcRn was analyzed in the AlphaLISA assay described in Example 3.

Results

Production of Z Variants:

The twelve FcRn binding Z variants constructed with an N-terminal His$_6$ tag were produced in *E. coli*. SDS-PAGE analysis of each final protein preparation showed that these predominantly contained the FcRn binding Z variant. The correct identity and molecular weight of each FcRn binding Z variant was confirmed by HPLC-MS analysis.

Biacore Binding and Kinetic Analyses:

The binding of the twelve Z variants to human FcRn and the dissociation at different pH were tested in a Biacore instrument by sequentially injecting each of the Z variants at pH 6.0 and either buffer pH 6.0 or pH 7.4 over a chip surface containing FcRn. The ligand immobilization level of the surface was 890 RU human FcRn. The twelve Z variants showed binding to FcRn at pH 6.0, and for all variants, faster off-rates were seen at pH 7.4 compared to pH 6.0.

The kinetic constants of the Z variants Z13577 (SEQ ID NO:725) and Z13621 (SEQ ID NO:750) interacting with FcRn at pH 6.0 were determined (see Table 10). Kinetic constants were calculated using curve sets of two or four injected concentrations of Z13577 and Z13621, respectively.

TABLE 10

Biacore kinetic constants and affinities for FcRn binding at pH 6.0.

| Z variant | SEQ ID NO: | $k_{on}$ (M$^{-1}$s$^{-1}$) | $k_{off}$ (s$^{-1}$) | $K_D$ (M) |
|---|---|---|---|---|
| Z13577 | 725 | $3.0 \times 10^5$ | $4.0 \times 10^{-3}$ | $13 \times 10^{-9}$ |
| Z13621 | 750 | $6.4 \times 10^5$ | $3.7 \times 10^{-3}$ | $6 \times 10^{-9}$ |

AlphaLISA Blocking Analysis:

The ability of twelve maturated His$_6$-tagged monomeric Z variants to inhibit IgG binding to FcRn was tested in an AlphaLISA blocking assay. Serial dilutions of the Z variants were incubated with biotinylated human FcRn and the blocking ability of each respective variant was measured after addition of IgG coated Acceptor beads and subsequently streptavidin coated Donor beads. Inhibition could be measured as a decrease in AlphaLISA counts for positive Z variants. All twelve tested Z variants were shown to block IgG binding to FcRn and the calculated 1050 values are shown in Table 11.

TABLE 11

Calculated IC50 values from AlphaLISA blocking assay.

| Z variant | SEQ ID NO: | IC50 (M) |
|---|---|---|
| Z13577 | 725 | $1.2 \times 10^{-8}$ |
| Z13578 | 726 | $1.2 \times 10^{-8}$ |
| Z13583 | 729 | $2.7 \times 10^{-9}$ |
| Z13592 | 734 | $6.4 \times 10^{-9}$ |
| Z13616 | 747 | $7.4 \times 10^{-9}$ |
| Z13621 | 750 | $3.2 \times 10^{-9}$ |
| Z13654 | 771 | $3.5 \times 10^{-9}$ |
| Z13663 | 776 | $1.1 \times 10^{-8}$ |
| Z13669 | 779 | $5.2 \times 10^{-9}$ |
| Z13674 | 781 | $2.5 \times 10^{-9}$ |
| Z13675 | 782 | $8.2 \times 10^{-9}$ |
| Z13676 | 783 | $3.9 \times 10^{-9}$ |

Example 10

Comparison of Blocking Capacity of IgG Binding to FcRn

In this example, the IgG blocking capacity of the FcRn binding Z variant $His_6$-Z07918 (SEQ ID NO:707) was compared to Intravenous immunoglobulin (IVIg) and Subcutaneous immunoglobulin (SCIg) currently used in the treatment of some autoimmune disorders.

Materials and Methods

Blocking of IgG-FcRn Immunofluorescence Staining:

Human or murine FcRn-eGFP transduced HeLa cells were prepared as described in Example 4. Fixed cells were resuspended in 50 µl of a mix of 50 nM Alexa647-conjugated human IgG (Jackson laboratories, cat. no. 009-600-003) and $His_6$-tagged Z07918, IVIg (OCTAGRAM, Octapharma) or SCIg (GAMMANORM, Octapharma), respectively, diluted at concentrations of 1000, 100, 10, 1, 0.1 or 0 (buffer control) nM in McIlvanes, pH 6.0, plus 2.5% FCS (Ultra low IgG, Life technologies) and 0.1% saponin (AppliChem). The cells were incubated for 1 h at 37° C. in the dark, washed with 2×100 µl McIlvanes, pH 6.0, plus 2.5% FCS (Ultra low IgG) pH 6.0 and re-suspended in 180 µl of McIlvanes, pH 6.0, plus 1% BSA. Data from 10,000 GFP/FcRn positive cells were obtained using a FACS Calibur (Beckman Coulter) and the data was analyzed using Flowing software 2.5.0 (Turku University).

Results

Figure 9:
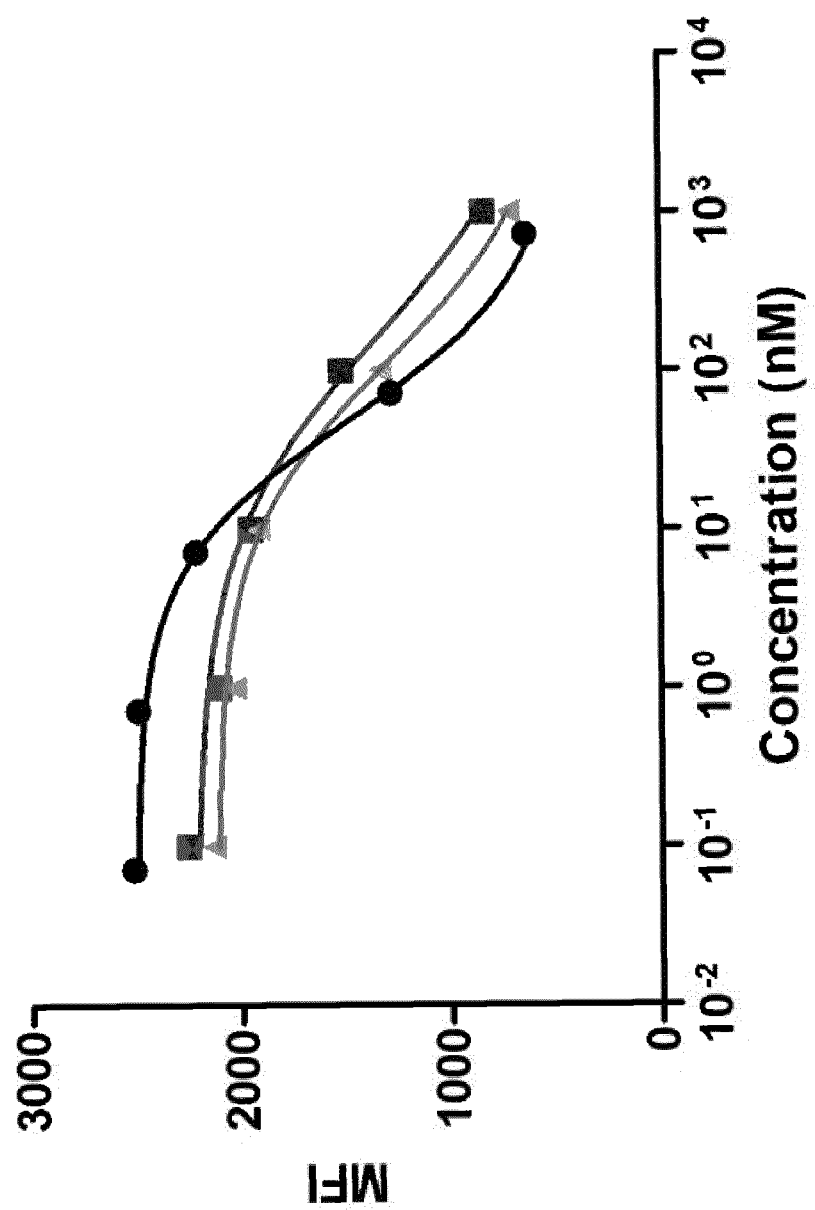
FIG. 9 shows the blocking of human IgG to human FcRn by $His_6$-Z07918 (SEQ ID NO:707; black circles), IVIg (grey squares) and SCIg (grey triangles), respectively, assayed as described in Example 10.
Figure 10:
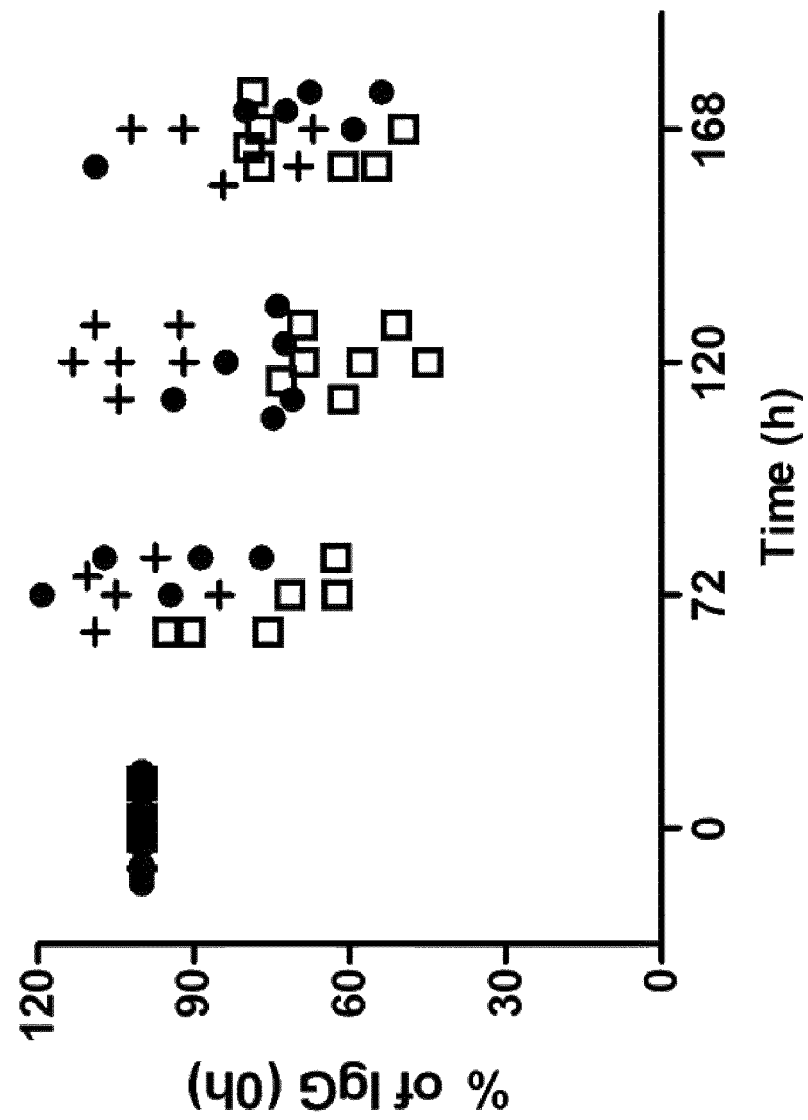
FIG. 10 shows that blocking of the IgG-FcRn interactions with FcRn specific Z variants in mice results in reduced levels of IgG. As further described in Example 11, mice were treated with five daily injections of Vehicle (+), the ABD fused Z variant Z07918-PP013 (open square) and Z11948 (SEQ ID NO:1060; closed circle). The concentration of endogenous IgG was measured by ELISA. The concentration of IgG in individual mice at 24, 72, 120 and 168 h were related to the level at 0 h and the results are therefore presented as percentage of IgG at 0 h.

The experiment was performed to determine if the FcRn binding Z variant $His_6$-Z07918 (SEQ ID NO:707) blocks the IgG-FcRn interaction and compare the blocking effect to IVIg and SCIg. Human or murine FcRn-eGFP transduced HeLa cells were incubated with human Alexa647-conjugated IgG. The binding was blocked with unlabeled $His_6$-Z07918, IVIg or SCIg at different concentrations. The results showed that $His_6$-Z07918 effectively blocked hIgG binding to hFcRn to a similar extent as IVIg or SCIg (FIG. 9).

Example 11

Increased IgG Catabolism by FcRn Binding Z Variants in Mice

The ability of the FcRn binding Z variant Z07918 to block IgG binding to FcRn in vitro was shown in Example 10. In this example, the blocking ability of the same Z variant was evaluated in vivo. Blocking of IgG-FcRn interactions in vivo will lead to increased IgG catabolism and concomitant reduced levels of IgG (Mezo 2008, supra).

Materials and Methods

Animal Study:

The FcRn-binding Z variants Z11948 (SEQ ID NO:1060) and Z07918-PP013 (Z07918 (SEQ ID NO:707) identical to Z11948 but with the N-terminus starting with the amino acids VD instead of AE, in fusion with the ABD variant PP013 (SEQ ID NO:1063)) or vehicle (PBS buffer), were administered to male NMRI (Charles River), at a dose of 16.3 µmol/kg. The mice were treated with five intravenous injections given at 0, 24, 48, 72 and 96 h. Serum samples were taken at 0, 72, 120 and 168 h (termination of study) and stored at −20° C. The concentration of mouse IgG in serum was quantified by ELISA.

Mouse IgG ELISA:

The concentration of mouse IgG in mouse serum samples was analyzed by a mouse IgG ELISA kit (Mabtech 3825-1AD-6) and performed as described by the manufacturer. The concentration of mIgG was calculated from a standard curve provided and GraphPad prism5 using a non-linear regression formula. The concentration of IgG in individual mice at 24, 72, 120 and 168 h were related to the level at 0 h and the results are therefore presented as percentage of IgG (0 h).

Results

The results showed a reduction of mouse IgG concentration in mice treated with FcRn-specific Z variants. Both Z11948 and the ABD-fused variant Z07918-PP013 lowered the concentration of endogenous IgG in mice in vivo. Most pronounced effects were obtained with the ABD-fused variant and after 120 hours. Thus, the results indicates that the FcRn-specific Z variants blocked recycling of IgG resulting in increased IgG catabolism and subsequent lower levels of IgG in mice.

Example 12

In Vitro Transcytosis of FcRn Binding Z Variants

In this example, the FcRn binding Z variants are tested for their ability to be transported through epithelial or endothelial cells or recycled by FcRn in vitro. A drug containing a Z variant with the power of transcytosis will facilitate drug uptake after for example oral or pulmonary administration.

Materials and Methods

Cells, for example T84, MDCK, HeLa, CaCo2, CaLu-1 and/or CaLu-3 cells, with or without endogenous or recombinant expression of FcRn, are grown in respective growth medium on a membrane in a transwell to form a monolayer. The integrity of monolayers can be evaluated by measuring the electrical resistance or adding a probe that is not able to penetrate or being actively transported over the cell monolayer. A defined monolayer of cells is pulsed from the apical or basolateral side with ligand such as FcRn binding Z variants, HSA or IgG in a buffer such as HBSS (Hanks' Balanced Salt Solution, SigmaAldrich, cat. no. H9269) or growth medium at a suitable pH and temperature, and chased with buffers such as HBSS or growth medium at a suitable pH and temperature on the opposite side.

In a variant of this assay, ligands can be chased with buffers such as HBSS or growth medium at suitable pH and temperature on the same side as administration to measure recycled ligand as well. This can be done in a transwell or in a cell culture dish. Cells are seeded into transwell or cell culture dishes and pulsed with ligands such as FcRn binding Z variants, HSA or IgG. Endocytosed ligands will bind to FcRn and return to the cell surface at the same or opposite side as they were loaded. After pulsing, free ligands are removed by washing the cells with cold buffer. To chase ligands, warm buffer or medium is added to the cells and, after a period in the range from 10 minutes to several hours, the buffer or medium is removed and assayed for the presence of ligands.

In a variant of this assay, ligands such as FcRn binding Z variants, HSA or IgG can be used to block the binding to FcRn by ligands such as other FcRn binding Z variants, HSA or IgG by administering them at the same time or sequentially to the cells.

The amount of ligand can be quantified by methods such as ELISA, HPLC-MS, fluorescent dye or radio labeling.

The results of the experiment described above are expected to show that the FcRn-specific Z variants can be transcytosed and/or recycled in vitro.

Itemized Listing of Embodiments

1. FcRn binding polypeptide, comprising an FcRn binding motif BM, which motif consists of the amino acid sequence $$EX_2\ X_3\ X_4\ AX_6\ X_7\ EIR\ WLPNLX_{16}X_{17}\ X_{18}\ QR$$
$$X_{21}\ AFIX_{25}\ X_{26}LX_{28}\ X_{29}$$
(SEQ ID NO: 1075)

wherein, independently from each other,
$X_2$ is selected from A, D, E, F, H, I, K, L, N, Q, R, S, T, V, W and Y;
$X_3$ is selected from A, D, E, F, G, H, I, K, L, M, N, Q, R, S, T, V, W and Y;
$X_4$ is selected from A, D, E, F, G, H, I, K, L, N, Q, R, S, T, V, W and Y;
$X_6$ is selected from A, E, F, G, H, I, K, Q, R, S and V;
$X_7$ is selected from A, F, H, K, N, Q, R, S and V;
$X_{16}$ is selected from N and T;
$X_{17}$ is selected from F, W and Y;
$X_{18}$ is selected from A, D, E and N;
$X_{21}$ is selected from A, S, V and W;
$X_{25}$ is selected from D, E, G, H, I, K, L, N, Q, R, S, T, V, W and Y;
$X_{26}$ is selected from K and S;
$X_{28}$ is selected from A, D, E, F, H, I, K, L, N, Q, R, S, T, V, W and Y; and
$X_{29}$ is selected from D and R.

2. FcRn binding polypeptide according to item 1, wherein, independently from each other,
$X_2$ is selected from A, D, E, F, H, I, K, L, N, Q, R, S, T, V, W and Y;
$X_3$ is selected from A, D, E, F, H, I, K, L, M, N, Q, R, S, T, V, W and Y;
$X_4$ is selected from A, D, E, F, H, I, K, L, N, Q, R, S, T, V, W and Y;
$X_6$ is selected from A, E, F, G, H, I, K, Q, R and S;
$X_7$ is selected from A, F, H, K, N, Q, R, S and V;
$X_{16}$ is selected from N and T;
$X_{17}$ is selected from F and Y;
$X_{18}$ is D;
$X_{21}$ is V;
$X_{25}$ is selected from D, E, H, I, K, L, N, Q, R, S, T, V, W and Y;
$X_{26}$ is selected from K and S;
$X_{28}$ is selected from A, D, E, F, H, I, K, L, N, Q, R, S, T, V and W; and
$X_{29}$ is selected from D and R.

3. FcRn binding polypeptide according to item 1, wherein the BM consists of an amino acid sequence selected from (SEQ ID NO: 1076)
i) $EX_2\ X_3\ X_4\ AX_6\ HEIR\ WLPN\text{-}LTX_{17}\ X_{18}\ QR\ X_{21}\ AFIX_{25}\ KLX_{28}\ D$ wherein, independently from each other,
$X_2$ is selected from A, D, E, F, H, I, K, L, N, Q, R, S, T, V, W and Y;
$X_3$ is selected from A, D, E, G, H, K, L, M, N, Q, R, S, T, V and Y;
$X_4$ is selected from A, D, E, F, G, I, K, L, N, Q, R, S, T, V and Y;
$X_6$ is selected from A, G, K, R, S and V;
$X_{17}$ is selected from F, W and Y;
$X_{18}$ is selected from A, D, E and N;
$X_{21}$ is selected from A, S, V and W;
$X_{25}$ is selected from D, G, H, K, L, N, R, V and W;
$X_{28}$ is selected from A, D, E, H, K, L, N, Q, R, S, T, W and Y; and ii) an amino acid sequence which has at least 96% identity to a sequence defined by i).

4. FcRn binding polypeptide according to any preceding item, wherein $X_2$ is selected from A, D, E, F, I, L, N, Q, R, S, T, V, W and Y.

5. FcRn binding polypeptide according to item 4, wherein $X_2$ is selected from A, D, F, I, L, N, Q, R, S, T, V and Y.

6. FcRn binding polypeptide according to item 5, wherein $X_2$ is selected from A, D, F, I, L, N, Q, R, S, V and W.

7. FcRn binding polypeptide according to item 5, wherein $X_2$ is selected from A, I, L, N, Q, R, S, T, V, W and Y.

8. FcRn binding polypeptide according to item 7, wherein $X_2$ is selected from A, I, L, N, Q, S, T, V and W.

9. FcRn binding polypeptide according to item 6 or 8, wherein $X_2$ is selected from A, I, L, N, Q, V and W.

10. FcRn binding polypeptide according to item 9, wherein $X_2$ is selected from A, I, L, Q, V and W.

11. FcRn binding polypeptide according to item 10, wherein $X_2$ is selected from A, I, L and Q.

12. FcRn binding polypeptide according to item 11, wherein $X_2$ is selected from I, L and Q.

13. FcRn binding polypeptide according to item 12, wherein $X_2$ is selected from I and Q.

14. FcRn binding polypeptide according to item 13, wherein $X_2$ is I.

15. FcRn binding polypeptide according to item 13, wherein $X_2$ is Q.

16. FcRn binding polypeptide according to any one of items 1 and 3-15, wherein $X_3$ is selected from A, D, E, G, H, K, L, M, N, Q, R, S, T, V and Y.

17. FcRn binding polypeptide according to item 2 or 16, wherein $X_3$ is selected from A, D, E, H, K, L, M, N, Q, R, S, T, V and Y.

18. FcRn binding polypeptide according to item 16, wherein $X_3$ is selected from A, D, E, G, H, K, L, M, N, Q, R, S and T.

19. FcRn binding polypeptide according to item 18, wherein $X_3$ is selected from A, D, E, G, H, K, M, N, Q, S and T.

20. FcRn binding polypeptide according to item 19, wherein $X_3$ is selected from A, D, E, G, H, M, N, Q, S and T.

21. FcRn binding polypeptide according to item 19, wherein $X_3$ is selected from A, D, E, K, N, Q, S and T.

22. FcRn binding polypeptide according to item 21, wherein $X_3$ is selected from A, D, E, K, Q and T.

23. FcRn binding polypeptide according to item 22, wherein $X_3$ is selected from A, D, E, Q and T.

24. FcRn binding polypeptide according to item 23, wherein $X_3$ is selected from D, E and T.

25. FcRn binding polypeptide according to item 24, wherein $X_3$ is selected from D and E.

26. FcRn binding polypeptide according to item 25, wherein $X_3$ is D.

27. FcRn binding polypeptide according to item 25, wherein $X_3$ is E.

28. FcRn binding polypeptide according to any one of items 1 and 3-27, wherein $X_4$ is selected from A, D, E, F, G, I, K, L, N, Q, R, S, T, V and Y.

29. FcRn binding polypeptide according to item 28, wherein $X_4$ is selected from A, D, E, G, N, Q, R, S, T and V.

30. FcRn binding polypeptide according to item 2 or 28, wherein $X_4$ is selected from A, D, E, F, I, K, L, N, Q, R, S, T and V.

31. FcRn binding polypeptide according to item 30, wherein $X_4$ is selected from A, D, E, I, K, N, Q, R, S and T.
32. FcRn binding polypeptide according to item 31, wherein $X_4$ is selected from A, D, E, I, K, Q, S and T.
33. FcRn binding polypeptide according to item 32, wherein $X_4$ is selected from A, D, I, K, Q and S.
34. FcRn binding polypeptide according to item 32, wherein $X_4$ is selected from A, D, E, K and S.
35. FcRn binding polypeptide according to item 33 or 34, wherein $X_4$ is selected from A, D, K and S.
36. FcRn binding polypeptide according to item 34, wherein $X_4$ is selected from A, D, E and K.
37. FcRn binding polypeptide according to item 35 or 36, wherein $X_4$ is selected from A, D and K.
38. FcRn binding polypeptide according to item 37, wherein $X_4$ is selected from A and D.
39. FcRn binding polypeptide according to item 36, wherein $X_4$ is selected from A and E.
40. FcRn binding polypeptide according to item 38 or 39, wherein $X_4$ is A.
41. FcRn binding polypeptide according to item 38, wherein $X_4$ is D.
42. FcRn binding polypeptide according to item 39, wherein $X_4$ is E.
43. FcRn binding polypeptide according to any one of items 1 and 4-42, wherein $X_6$ is selected from A, G, K, Q, R, S and V.
44. FcRn binding polypeptide according to item 3 or 43, wherein $X_6$ is selected from A, G, K, R, S and V.
45. FcRn binding polypeptide according to item 2 or 44, wherein $X_6$ is selected from A, G, K, R and S.
46. FcRn binding polypeptide according to item 44, wherein $X_6$ is selected from A, G, K, S and V.
47. FcRn binding polypeptide according to item 46, wherein $X_6$ is selected from A, G, K and V.
48. FcRn binding polypeptide according to item 45 or 46, wherein $X_6$ is selected from A, G, K and S.
49. FcRn binding polypeptide according to item 47 or 48, wherein $X_6$ is selected from A, G and K.
50. FcRn binding polypeptide according to item 47, wherein $X_6$ is selected from A, G and V.
51. FcRn binding polypeptide according to item 49 or 50, wherein $X_6$ is selected from A and G.
52. FcRn binding polypeptide according to item 51, wherein $X_6$ is A.
53. FcRn binding polypeptide according to item 51, wherein $X_6$ is G.
54. FcRn binding polypeptide according to any one of items 1, 2 and 4-53, wherein $X_7$ is selected from A and H.
55. FcRn binding polypeptide according to item 54, wherein $X_7$ is H.
56. FcRn binding polypeptide according to any one of items 1, 2 and 4-55, wherein $X_{16}$ is T.
57. FcRn binding polypeptide according to any one of items 1, 2 and 4-55, wherein $X_{16}$ is N.
58. FcRn binding polypeptide according to any one of items 1 and 3-57, wherein $X_{17}$ is selected from F and Y.
59. FcRn binding polypeptide according to any preceding item, wherein $X_{17}$ is F.
60. FcRn binding polypeptide according to any one of items 1 and 3-59, wherein $X_{18}$ is selected from A, D and E.
61. FcRn binding polypeptide according to item 60, wherein $X_{18}$ is selected from A and D.
62. FcRn binding polypeptide according to item 61, wherein $X_{18}$ is D.
63. FcRn binding polypeptide according to any one of items 1 and 3-62, wherein $X_{21}$ is selected from V and W.
64. FcRn binding polypeptide according to item 63, wherein $X_{21}$ is V.
65. FcRn binding polypeptide according to any one of items 1 and 4-64, wherein $X_{25}$ is selected from D, E, G, H, K, L, N, Q, R, V and W.
66. FcRn binding polypeptide according to item 65, wherein $X_{25}$ is selected from D, G, H, K, L, N, R, V and W.
67. FcRn binding polypeptide according to any one of items 2, 3 and 66, wherein $X_{25}$ is selected from H, L, R, V and W.
68. FcRn binding polypeptide according to item 67, wherein $X_{25}$ is selected from H, R, V and W.
69. FcRn binding polypeptide according to item 68, wherein $X_{25}$ is selected from H, R and V.
70. FcRn binding polypeptide according to item 67, wherein $X_{25}$ is selected from H, L and R.
71. FcRn binding polypeptide according to item 69 or 70, wherein $X_{25}$ is selected from H and R.
72. FcRn binding polypeptide according to item 69, wherein $X_{25}$ is selected from H and V.
73. FcRn binding polypeptide according to item 71 or 72, wherein $X_{25}$ is H.
74. FcRn binding polypeptide according to any one of items 1, 2 and 4-73, wherein $X_{26}$ is K.
75. FcRn binding polypeptide according to any one of items 1, 2 and 4-73, wherein $X_{26}$ is S.
76. FcRn binding polypeptide according to any one of items 1 and 3-75, wherein $X_{28}$ is selected from A, D, E, H, K, L, N, Q, R, S, T, W and Y.
77. FcRn binding polypeptide according to item 76, wherein $X_{28}$ is selected from A, D, E, K, L, N, Q, R, S, T, W and Y.
78. FcRn binding polypeptide according to item 77, wherein $X_{28}$ is selected from A, D, E, L, R, S, T, W and Y.
79. FcRn binding polypeptide according to item 2 or 77, wherein $X_{28}$ is selected from A, D, K, L, N, Q, R, S, T and W.
80. FcRn binding polypeptide according to item 78 or 79, wherein $X_{28}$ is selected from A, D and R.
81. FcRn binding polypeptide according to item 80, wherein $X_{28}$ is selected from A and R.
82. FcRn binding polypeptide according to item 80, wherein $X_{28}$ is selected from D and R.
83. FcRn binding polypeptide according to item 81, wherein $X_{28}$ is A.
84. FcRn binding polypeptide according to item 81 or 82, wherein $X_{28}$ is R.
85. FcRn binding polypeptide according to item 82, wherein $X_{28}$ is D.
86. FcRn binding polypeptide according to any one of items 1, 2 and 4-85, wherein $X_{29}$ is D.
87. FcRn binding polypeptide according to any one of items 1, 2 and 4-85, wherein $X_{29}$ is R.
88. FcRn binding polypeptide according to any one of items 1, 2 and 4-87, wherein $X_6X_7$ is selected from AH and GH.
89. FcRn binding polypeptide according to item 88, wherein $X_6X_7$ is AH.
90. FcRn binding polypeptide according to item 88, wherein $X_6X_7$ is GH.
91. FcRn binding polypeptide according to any preceding item, wherein $X_{17}X_{18}$ is selected from FD and YD.
92. FcRn binding polypeptide according to item 91, wherein $X_{17}X_{18}$ is FD.
93. FcRn binding polypeptide according to any preceding item, wherein the sequence fulfills at least three of the six conditions I-VI:

I. $X_6$ is selected from A, G, K and S, such as in particular A;
II. $X_7$ is H;
III. $X_{17}$ is selected from F and Y, such as in particular F;
IV. $X_{18}$ is D;
V. $X_{21}$ is selected from V and W, such as in particular V;
VI. $X_{25}$ is selected from H and R, such as in particular H.

94. FcRn binding polypeptide according to item 93, wherein the sequence fulfills at least four of the six conditions I-VI.
95. FcRn binding polypeptide according to item 94, wherein the sequence fulfills at least five of the six conditions I-VI.
96. FcRn binding polypeptide according to item 95, wherein the sequence fulfills all of the six conditions I-VI.
97. FcRn binding polypeptide according to any preceding item, wherein the sequence is selected from the group consisting of SEQ ID NO:1-353.
98. FcRn binding polypeptide according to item 97, wherein the sequence is selected from the group consisting of SEQ ID NO:1-15, SEQ ID NO:17-140 and SEQ ID NO:353.
99. FcRn binding polypeptide according to item 98, wherein the sequence is selected from the group consisting of SEQ ID NO:1-2 and SEQ ID NO:17-140.
100. FcRn binding polypeptide according to item 99, wherein the sequence is selected from the group consisting of SEQ ID NO:1-2, SEQ ID NO:17-92, SEQ ID NO:94-103, SEQ ID NO:105-125 and SEQ ID NO:127-140.
101. FcRn binding polypeptide according to item 98, wherein the sequence is selected from the group consisting of SEQ ID NO:1-8, SEQ ID NO:13, SEQ ID NO:19-20, SEQ ID NO:23, SEQ ID NO:28, SEQ ID NO:41, SEQ ID NO:44, SEQ ID NO:65, SEQ ID NO:70, SEQ ID NO:73, SEQ ID NO:75-77 and SEQ ID NO:353.
102. FcRn binding polypeptide according to item 100 or 101, wherein the sequence is selected from the group consisting of SEQ ID NO:1, SEQ ID NO:23, SEQ ID NO:28, SEQ ID NO:41, SEQ ID NO:44, SEQ ID NO:65, SEQ ID NO:73 and SEQ ID NO:75-77.
103. FcRn binding polypeptide according to item 102, wherein the sequence is selected from the group consisting of SEQ ID NO:1, SEQ ID NO:23, SEQ ID NO:44, SEQ ID NO:65, SEQ ID NO:75 and SEQ ID NO:77.
104. FcRn binding polypeptide according to item 103, wherein the sequence is selected from the group consisting of SEQ ID NO:1, SEQ ID NO:23 and SEQ ID NO:75.
105. FcRn binding polypeptide according to item 104, wherein the sequence is SEQ ID NO:1.
106. FcRn binding polypeptide according to any preceding item, wherein said FcRn binding motif forms part of a three-helix bundle protein domain.
107. FcRn binding polypeptide according to item 106, wherein said FcRn binding motif essentially forms part of two helices with an interconnecting loop, within said three-helix bundle protein domain.
108. FcRn binding polypeptide according to item 107, wherein said three-helix bundle protein domain is selected from bacterial receptor domains.
109. FcRn binding polypeptide according to item 108, wherein said three-helix bundle protein domain is selected from domains of protein A from *Staphylococcus aureus* or derivatives thereof.
110. FcRn binding polypeptide according to any preceding item, which comprises an amino acid sequence selected from:

(SEQ ID NO: 1077)
iii) K-[BM]-DPSQS $X_aX_bLLX_c$ EAKKL $X_dX_eX_fQ$;

wherein
[BM] is an FcRn binding motif as defined herein, provided that $X_{29}$ is D;
$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S;
and
iv) an amino acid sequence which has at least 93% identity to a sequence defined by iii).

111. FcRn binding polypeptide according to any one of items 1-109, which comprises an amino acid sequence selected from (SEQ ID NO: 1080)
v) K-[BM]-QPEQS $X_aX_bLLX_c$ EAKKL $X_dX_eX_fQ$;

wherein
[BM] is an FcRn binding motif as defined herein, provided that $X_{29}$ is R;
$X_a$ is selected from A and S;
$X_b$ is selected from N and E;
$X_c$ is selected from A, S and C;
$X_d$ is selected from E, N and S;
$X_e$ is selected from D, E and S;
$X_f$ is selected from A and S;
and
vi) an amino acid sequence which has at least 93% identity to a sequence defined by v).

112. FcRn binding polypeptide according to item 110 or 111, wherein $X_a$ in sequence iii) or v) is A.
113. FcRn binding polypeptide according to item 110 or 111, wherein $X_a$ in sequence iii) or v) is S.
114. FcRn binding polypeptide according to any one of items 110-113, wherein $X_b$ in sequence iii) or v) is N.
115. FcRn binding polypeptide according to any one of items 110-113, wherein $X_b$ in sequence iii) or v) is E.
116. FcRn binding polypeptide according to any one of items 110-115, wherein $X_c$ in sequence iii) or v) is A.
117. FcRn binding polypeptide according to any one of items 110-115, wherein $X_c$ in sequence iii) or v) is S.
118. FcRn binding polypeptide according to any one of items 110-115, wherein $X_c$ in sequence iii) or v) is C.
119. FcRn binding polypeptide according to any one of items 110-118, wherein $X_d$ in sequence iii) or v) is E.
120. FcRn binding polypeptide according to any one of items 110-118, wherein $X_d$ in sequence iii) or v) is N.
121. FcRn binding polypeptide according to any one of items 110-118, wherein $X_d$ in sequence iii) or v) is S.
122. FcRn binding polypeptide according to any one of items 110-121, wherein $X_e$ in sequence iii) or v) is D.
123. FcRn binding polypeptide according to any one of items 110-121, wherein $X_e$ in sequence iii) or v) is E.
124. FcRn binding polypeptide according to any one of items 110-121, wherein $X_e$ in sequence iii) or v) is S.
125. FcRn binding polypeptide according to any one of items 110-119, 121, 123 and 124, wherein $X_dX_e$ in sequence iii) or v) is selected from EE, ES, SE and SS.
126. FcRn binding polypeptide according to item 125, wherein $X_dX_e$ in sequence iii) or v) is ES.

127. FcRn binding polypeptide according to item 125, wherein $X_dX_e$ in sequence iii) or v) is SE.
128. FcRn binding polypeptide according to any one of items 110-127, wherein $X_f$ in sequence iii) or v) is A.
129. FcRn binding polypeptide according to any one of items 110-127, wherein $X_f$ in sequence iii) or v) is S.
130. FcRn binding polypeptide according to item 110 or 111, wherein in sequence iii) or v), $X_a$ is A; $X_b$ is N; $X_c$ is A and $X_f$ is A.
131. FcRn binding polypeptide according to item 110 or 111, wherein in sequence iii) or v), $X_a$ is A; $X_b$ is N; $X_c$ is C and $X_f$ is A.
132. FcRn binding polypeptide according to item 110 or 111, wherein in sequence iii) or v), $X_a$ is S; $X_b$ is E; $X_c$ is S and $X_f$ is S.
133. FcRn binding polypeptide according to item 110 or 111, wherein in sequence iii) or v), $X_a$ is S; $X_b$ is E; $X_c$ is C and $X_f$ is S.
134. FcRn binding polypeptide according to item 110 or 111, wherein in sequence iii) or v), $X_a$ is A; $X_b$ is N; $X_c$ is A; $X_dX_e$ is ND and $X_f$ is A.
135. FcRn binding polypeptide according to item 110 or 111, wherein in sequence iii) or v), $X_a$ is A; $X_b$ is N; $X_c$ is C; $X_dX_e$ is ND and $X_f$ is A.
136. FcRn binding polypeptide according to item 110 or 111, wherein in sequence iii) or v), $X_a$ is S; $X_b$ is E; $X_c$ is S; $X_dX_e$ is ND and $X_f$ is S.
137. FcRn binding polypeptide according to item 110 or 111, wherein in sequence iii) or v), $X_a$ is S; $X_b$ is E; $X_c$ is C; $X_dX_e$ is ND and $X_f$ is S.
138. FcRn binding polypeptide according to item 110 or 111, wherein in sequence iii) or v), $X_a$ is A; $X_b$ is N; $X_c$ is A; $X_dX_e$ is SE and $X_f$ is A.
139. FcRn binding polypeptide according to item 110 or 111, wherein in sequence iii) or v), $X_a$ is A; $X_b$ is N; $X_c$ is C; $X_dX_e$ is SE and $X_f$ is A.
140. FcRn binding polypeptide according to item 110 or 111, wherein in sequence iii) or v), $X_a$ is S; $X_b$ is E; $X_c$ is S; $X_dX_e$ is SE and $X_f$ is S.
141. FcRn binding polypeptide according to item 110 or 111, wherein in sequence iii) or v), $X_a$ is S; $X_b$ is E; $X_c$ is C; $X_dX_e$ is SE and $X_f$ is S.
142. FcRn binding polypeptide according to item 110 or 111, wherein in sequence iii) or v), $X_a$ is A; $X_b$ is N; $X_c$ is A; $X_dX_e$ is ES and $X_f$ is A.
143. FcRn binding polypeptide according to item 110 or 111, wherein in sequence iii) or v), $X_a$ is A; $X_b$ is N; $X_c$ is C; $X_dX_e$ is ES and $X_f$ is A.
144. FcRn binding polypeptide according to item 110 or 111, wherein in sequence iii) or v), $X_a$ is S; $X_b$ is E; $X_c$ is S; $X_dX_e$ is ES and $X_f$ is S.
145. FcRn binding polypeptide according to item 110 or 111, wherein in sequence iii) or v), $X_a$ is S; $X_b$ is E; $X_c$ is C; $X_dX_e$ is ES and $X_f$ is S
146. FcRn binding polypeptide according to any one of items 110 and 112-145, wherein sequence iii) is selected from the group consisting of SEQ ID NO:354-706.
147. FcRn binding polypeptide according to item 146, wherein sequence iii) is selected from the group consisting of SEQ ID NO:354-368, SEQ ID NO:370-493 and SEQ ID NO:706.
148. FcRn binding polypeptide according to item 147, wherein sequence iii) is selected from the group consisting of SEQ ID NO:354-355 and SEQ ID NO:370-493.
149. FcRn binding polypeptide according to item 148, wherein sequence iii) is selected from the group consisting of SEQ ID NO:354-355, SEQ ID NO:370-445, SEQ ID NO:447-456, SEQ ID NO:458-478 and SEQ ID NO:480-493.
150. FcRn binding polypeptide according to item 147, wherein sequence iii) is selected from the group consisting of SEQ ID NO:354-361, SEQ ID NO:366, SEQ ID NO:372-373, SEQ ID NO:376, SEQ ID NO:381, SEQ ID NO:394, SEQ ID NO:397, SEQ ID NO:418, SEQ ID NO:423, SEQ ID NO:426, SEQ ID NO:428-430 and SEQ ID NO:706.
151. FcRn binding polypeptide according to item 149 or 150, wherein sequence iii) is selected from the group consisting of SEQ ID NO:354, SEQ ID NO:376, SEQ ID NO:381, SEQ ID NO:394, SEQ ID NO:397, SEQ ID NO:418, SEQ ID NO:426 and SEQ ID NO:428-430.
152. FcRn binding polypeptide according to item 151, wherein sequence iii) is selected from the group consisting of SEQ ID NO:354, SEQ ID NO:376, SEQ ID NO:397, SEQ ID NO:418, SEQ ID NO:428 and SEQ ID NO:430.
153. FcRn binding polypeptide according to item 152, wherein sequence iii) is selected from the group consisting of SEQ ID NO:354, SEQ ID NO:376 and SEQ ID NO:428.
154. FcRn binding polypeptide according to item 153, wherein sequence iii) is SEQ ID NO:354.
155. FcRn binding polypeptide according to any one of items 1-109, which comprises an amino acid sequence selected from:

```
                                    (SEQ ID NO: 1081)
vii) YAK-[BM]-DPSQS SELLXc EAKKL NDSQA P;
``` wherein [BM] is an FcRn binding motif as defined in any one of items 1-105 and $X_c$ is selected from A, S and C; and
viii) an amino acid sequence which has at least 94% identity to a sequence defined by vii).
156. FcRn binding polypeptide according to any one of items 1-109, which comprises an amino acid sequence selected from:

```
                                    (SEQ ID NO: 1082)
ix) FNK-[BM]-DPSQS ANLLXc EAKKL NDAQA P;
``` wherein [BM] is an FcRn binding motif as defined in any one of items 1-105 and $X_c$ is selected from A and C; and
x) an amino acid sequence which has at least 94% identity to a sequence defined by ix).
157. FcRn binding polypeptide according to item 109, which comprises an amino acid sequence selected from:

```
                                    (SEQ ID NO: 1083)
ADNNFNK-[BM]-DPSQSANLLSEAKKLNESQAPK;

(SEQ ID NO: 1084)
ADNKFNK-[BM]-DPSQSANLLAEAKKLNDAQAPK;

(SEQ ID NO: 1085)
ADNKFNK-[BM]-DPSVSKEILAEAKKLNDAQAPK;

(SEQ ID NO: 1086)
ADAQQNNFNK-[BM]-DPSQSTNVLGEAKKLNESQAPK;

(SEQ ID NO: 1087)
AQHDE-[BM]-DPSQSANVLGEAQKLNDSQAPK;

(SEQ ID NO: 1088)
VDNKFNK-[BM]-DPSQSANLLAEAKKLNDAQAPK;
```

```
                                      (SEQ ID NO: 1089)
AEAKYAK-[BM]-DPSESSELLSEAKKLNKSQAPK;

(SEQ ID NO: 1090)
VDAKYAK-[BM]-DPSQSSELLAEAKKLNDAQAPK;

(SEQ ID NO: 1091)
VDAKYAK-[BM]-DPSQSSELLAEAKKLNDSQAPK;

(SEQ ID NO: 1092)
AEAKYAK-[BM]-DPSQSSELLSEAKKLNDSQAPK;

(SEQ ID NO: 1093)
AEAKYAK-[BM]-DPSQSSELLSEAKKLSESQAPK;

(SEQ ID NO: 1094)
AEAKYAK-[BM]-DPSQSSELLSEAKKLESSQAPK;

(SEQ ID NO: 1095)
VDAKYAK-[BM]-DPSQSSELLSEAKKLNDSQAPK;

(SEQ ID NO: 1096)
VDAKYAK-[BM]-DPSQSSELLSEAKKLSESQAPK;

(SEQ ID NO: 1097)
VDAKYAK-[BM]-DPSQSSELLSEAKKLESSQAPK;

(SEQ ID NO: 1098)
VDAKYAK-[BM]-DPSQSSELLAEAKKLNKAQAPK;
and (SEQ ID NO: 1099)
AEAKYAK-[BM]-DPSQSSELLAEAKKLNKAQAPK;
``` wherein [BM] is an FcRn binding motif as defined in any one of items 1-105.

158. FcRn binding polypeptide according to any preceding item, which comprises an amino acid sequence selected from:

```
                                      (SEQ ID NO: 1078)
    xi) AEAKYAK-[BM]-DPSQSSELLSEAKKLNDSQAPK;
``` wherein [BM] is an FcRn binding motif as defined in any one of items 1-105; and xii) an amino acid sequence which has at least 94% identity to the sequence defined in xi).

159. FcRn binding polypeptide according to item 158, in which sequence xi) is selected from the group consisting of SEQ ID NO:1060-1062.

160. FcRn binding polypeptide according to any preceding item, which comprises an amino acid sequence selected from:

```
                                      (SEQ ID NO: 1079)
    xiii) VDAKYAK-[BM]-DPSQSSELLSEAKKLNDSQAPK;
``` wherein [BM] is an FcRn binding motif as defined in any one of items 1-105; and xiv) an amino acid sequence which has at least 94% identity to the sequence defined in xiii).

161. FcRn binding polypeptide according to item 160, in which sequence xiii) is selected from the group consisting of SEQ ID NO: 707-1059.

162. FcRn binding polypeptide according to item 161, in which sequence xiii) is selected from the group consisting of SEQ ID NO:707-721, SEQ ID NO:723-846 and SEQ ID NO:1059.

163. FcRn binding polypeptide according to item 162, in which sequence xiii) is selected from the group consisting of SEQ ID NO:707-708 and SEQ ID NO:723-846.

164. FcRn binding polypeptide according to item 163, in which sequence xiii) is selected from the group consisting of SEQ ID NO:707-708, SEQ ID NO:723-798, SEQ ID NO:800-809, SEQ ID NO:811-831 and SEQ ID NO:833-846.

165. FcRn binding polypeptide according to item 162, in which sequence xiii) is selected from the group consisting of SEQ ID NO:707-714, SEQ ID NO:719, SEQ ID NO:725-726, SEQ ID NO:729, SEQ ID NO:734, SEQ ID NO:747, SEQ ID NO:750, SEQ ID NO:771, SEQ ID NO:776, SEQ ID NO:779, SEQ ID NO:781-783 and SEQ ID NO:1059.

166. FcRn binding polypeptide according to item 163 or 165, in which sequence xiii) is selected from the group consisting of SEQ ID NO:707, SEQ ID NO:729, SEQ ID NO:734, SEQ ID NO:747, SEQ ID NO:750, SEQ ID NO:771, SEQ ID NO:779 and SEQ ID NO:781-783.

167. FcRn binding polypeptide according to item 166, in which sequence xiii) is selected from the group consisting of SEQ ID NO:707, SEQ ID NO:729, SEQ ID NO:750, SEQ ID NO:771, SEQ ID NO:781 and SEQ ID NO:783.

168. FcRn binding polypeptide according to item 167, in which sequence xiii) is selected from the group consisting of SEQ ID NO:707, SEQ ID NO:729 and SEQ ID NO:781.

169. FcRn binding polypeptide according to item 168, in which sequence xiii) is SEQ ID NO:707.

170. FcRn binding polypeptide according to any preceding item, which is capable of binding to FcRn at pH 6.0 such that the $K_D$ value of the interaction is at most $1 \times 10^{-6}$ M, such as at most $1 \times 10^{-7}$ M, such as at most $1 \times 10^{-8}$ M, such as at most $1 \times 10^{-9}$ M, such as at most $1 \times 10^{-10}$ M.

171. FcRn binding polypeptide according to any preceding item, wherein the $K_D$ value of the interaction between FcRn binding polypeptide and FcRn at pH 7.4 is higher than the $K_D$ value of said interaction at pH 6.0, such as at least 2 times higher, such as at least 5 times higher, such as at least 10 times higher, such as at least 50 times higher, such as at least 100 times higher than the $K_D$ value of said interaction at pH 6.0.

172. FcRn binding polypeptide according to any preceding item, wherein the $K_D$ value of said interaction at pH 7.4 is at least $1 \times 10^{-8}$ M, such as at least $1 \times 10^{-7}$ M, such as at least $1 \times 10^{-6}$ M, such as at least $1 \times 10^{-5}$ M.

173. FcRn binding polypeptide according to any one of items 1-170, wherein the $K_D$ value of said interaction at pH 7.4 is the same as or lower than the $K_D$ value of said interaction at pH 6.0.

174. FcRn binding polypeptide according to any one of items 1-170, wherein the $K_D$ value of said interaction at pH 7.4 is at most $1 \times 10^{-6}$ M, such as at most $1 \times 10^{-7}$ M, such as at most $1 \times 10^{-8}$ M, such as at most $1 \times 10^{-9}$ M, such as at most $1 \times 10^{-10}$ M.

175. FcRn binding polypeptide according to any preceding item, which comprises at least one additional amino acid at the C-terminal and/or N-terminal end.

176. FcRn binding polypeptide according to item 175, wherein said at least one additional amino acid extension improves production, purification, stabilization in vivo or in vitro, coupling or detection of the polypeptide.

177. FcRn binding polypeptide according to any preceding item in multimeric form, comprising at least two FcRn binding polypeptide monomer units, whose amino acid sequences may be the same or different.

178. FcRn binding polypeptide according to item 177, wherein said FcRn binding polypeptide monomer units are covalently coupled together.

179. FcRn binding polypeptide according to item 177, wherein the FcRn binding polypeptide monomer units are expressed as a fusion protein.
180. FcRn binding polypeptide according to any one of items 177-179, in dimeric form.
181. Fusion protein or conjugate comprising
    a first moiety consisting of an FcRn binding polypeptide according to any preceding item; and
    a second moiety consisting of a polypeptide having a desired biological activity.
182. Fusion protein or conjugate according to item 181, wherein the in vivo half-life of said fusion protein or conjugate is longer than the in vivo half-life of the polypeptide having a desired biological activity per se.
183. Fusion protein or conjugate according to any one of items 181-182, wherein said desired biological activity is a therapeutic activity.
184. Fusion protein or conjugate according to any one of items 181-182, wherein said desired biological activity is a binding activity to a selected target.
185. Fusion protein or conjugate according to item 184, wherein said selected target is albumin.
186. Fusion protein or conjugate according to item 185, wherein said albumin binding activity is provided by the albumin binding domain of streptococcal protein G, or a derivative thereof.
187. Fusion protein or conjugate according to any one of items 185-189, wherein said albumin binding activity increases in vivo half-life of the fusion protein or conjugate.
188. Fusion protein or conjugate according to any one of items 181-182, wherein said desired biological activity is an enzymatic activity.
189. Fusion protein or conjugate according to any one of items 181-183, wherein the second moiety having a desired biological activity is a therapeutically active polypeptide.
190. Fusion protein or conjugate according to any one of items 181-183 and 188-189, wherein the second moiety having a desired biological activity is selected from the group consisting of enzymes, hormones, growth factors, chemokines and cytokines.
191. FcRn binding polypeptide, fusion protein or conjugate according to any preceding item, which inhibits binding of IgG to FcRn.
192. FcRn binding polypeptide, fusion protein or conjugate according to item 191, wherein the $K_D$ value of the interaction between said FcRn binding polypeptide, fusion protein or conjugate and FcRn is lower than the $K_D$ value of the interaction between IgG and FcRn.
193. FcRn binding polypeptide, fusion protein or conjugate according to any preceding item, further comprising a label.
194. FcRn binding polypeptide, fusion protein or conjugate according to item 193, wherein said label is selected from the group consisting of fluorescent dyes and metals, chromophoric dyes, chemiluminescent compounds and bioluminescent proteins, enzymes, radionuclides and particles.
195. FcRn binding polypeptide, fusion protein or conjugate according to any preceding item, comprising a chelating environment provided by a polyaminopolycarboxylate chelator conjugated to the FcRn binding polypeptide via a thiol group of a cysteine residue or an amine group of a lysine residue.
196. FcRn binding polypeptide, fusion protein or conjugate according to item 195, wherein the polyaminopolycarboxylate chelator is 1,4,7,10-tetraazacyclododecane-1,4,7,10-tetraacetic acid or a derivative thereof.
197. FcRn binding polypeptide, fusion protein or conjugate according to item 196, wherein the 1,4,7,10-tetraazacyclododecane-1,4,7,10-tetraacetic acid derivative is 1,4,7,10-tetraazacyclododecane-1,4,7-tris-acetic acid-10-maleimidoethylacetamide.
198. FcRn binding polypeptide, fusion protein or conjugate according to item 195, wherein the polyaminopolycarboxylate chelator is 1,4,7-triazacyclononane-1,4,7-triacetic acid or a derivative thereof.
199. FcRn binding polypeptide, fusion protein or conjugate according to item 195, wherein the polyaminopolycarboxylate chelator is diethylenetriaminepentaacetic acid or derivatives thereof.
200. A polynucleotide encoding a polypeptide according to any one of items 1-192.
201. Expression vector comprising a polynucleotide according to item 200.
202. Host cell comprising an expression vector according to item 201.
203. Method of producing a polypeptide according to any one of items 1-192, comprising
    culturing a host cell according to item 202 under conditions permissive of expression of said polypeptide from said expression vector, and
    isolating said polypeptide.
204. Composition comprising an FcRn binding polypeptide, fusion protein or conjugate according to any one of items 1-199 and at least one pharmaceutically acceptable excipient or carrier.
205. Composition according to item 204, further comprising at least one additional active agent.
206. Composition according to any one of items 204-205, which is adapted for administration by a route selected from the group consisting of oral administration, intranasal administration, pulmonar administration, vaginal administration, rectal administration, intravenous injection, intraperitoneal injection, intramuscular injection, subcutaneous injection and intradermal injection.
207. FcRn binding polypeptide, fusion protein or conjugate according to any one of items 1-199 or composition according to any one of items 204-206 for use as a medicament.
208. FcRn binding polypeptide, fusion protein, conjugate or composition for use according to item 207, wherein said medicament is intended for treatment of an auto-immune condition.
209. FcRn binding polypeptide, fusion protein, conjugate or composition for use according to item 207 or 208, wherein said medicament is intended for treatment of a condition selected from the group consisting of myasthenia gravis, Guillain-Barré syndrome, autoimmune limbic encephalitis, pediatric autoimmune neuropsychiatric disorders associated with streptococcal infection (PANDAS), neuromyotonia (Isaac's syndrome), morvan syndrome, multiple sclerosis, pemphigus vulgaris, foliaceus, bullous pemphigoid, epidermolysis bullosa acquisita, pemphigoid gestationis, mucous membrane pemphigoid, lichen sclerosus, antiphospholipid syndrome, erlapsing polychondritis, autoimmune anemia, idiopathic trombocytic purpura, autoimmune Grave's disease, dilated cardiomyopathy, vasculitis, Goodpasture's syndrome, idiopathic membranous nephropathy, rheumatoid arthritis and systemic lupus erythematosus.
210. Method of treatment of a subject in need thereof, comprising administering to the subject a therapeutically active amount of an FcRn binding polypeptide, fusion protein or conjugate according to any one of items 1-199 or composition according to any one of items 204-206.

211. Method according to item 210, for treatment of an auto-immune condition.

212. Method according to item 210 or 211, wherein said subject is suffering from a condition selected from the group consisting of myasthenia gravis, Guillain-Barré syndrome, autoimmune limbic encephalitis, pediatric autoimmune neuropsychiatric disorders associated with streptococcal infection (PANDAS), neuromyotonia (Isaac's syndrome), morvan syndrome, multiple sclerosis, pemphigus vulgaris, foliaceus, bullous pemphigoid, epidermolysis bullosa acquisita, pemphigoid gestationis, mucous membrane pemphigoid, lichen sclerosus, antiphospholipid syndrome, erlapsing polychondritis, autoimmune anemia, idiopathic trombocytic purpura, autoimmune Grave's disease, dilated cardiomyopathy, vasculitis, Goodpasture's syndrome, idiopathic membranous nephropathy, rheumatoid arthritis and systemic lupus erythematosus.

SEQUENCE LISTING (1106 sequences)

SEQ ID NO: 1 - protein, 29 aa, ARTIFICIAL SEQUENCE
  Engineered FcRn binding polypeptide
EQDAAAHEIRWLPNLTFDQRVAFIHKLAD

SEQ ID NO: 2 - protein, 29 aa, ARTIFICIAL SEQUENCE
  Engineered FcRn binding polypeptide
EWMRAAHEIRWLPNLTFDQRVAFIHKLED

SEQ ID NO: 3 - protein, 29 aa, ARTIFICIAL SEQUENCE
  Engineered FcRn binding polypeptide
EANTAAHEIRWLPNLTFDQRVAFIRKLWD

SEQ ID NO: 4 - protein, 29 aa, ARTIFICIAL SEQUENCE
  Engineered FcRn binding polypeptide
EFESAAHEIRWLPNLTYDQRVAFIHKLSD

SEQ ID NO: 5 - protein, 29 aa, ARTIFICIAL SEQUENCE
  Engineered FcRn binding polypeptide
ERSAAAHEIRWLPNLTFDQRVAFILKLTD

SEQ ID NO: 6 - protein, 29 aa, ARTIFICIAL SEQUENCE
  Engineered FcRn binding polypeptide
ESDSAVHEIRWLPNLTFDQRVAFIHKLLD

SEQ ID NO: 7 - protein, 29 aa, ARTIFICIAL SEQUENCE
  Engineered FcRn binding polypeptide
EADNAGHEIRWLPNLTWAQRWAFIHKLLD

SEQ ID NO: 8 - protein, 29 aa, ARTIFICIAL SEQUENCE
  Engineered FcRn binding polypeptide
EDDTAAHEIRWLPNLTYEQRWAFIHKLYD

SEQ ID NO: 9 - protein, 29 aa, ARTIFICIAL SEQUENCE
  Engineered FcRn binding polypeptide
EQHDAAHEIRWLPNLTYDQRVAFIRKLHD

SEQ ID NO: 10 - protein, 29 aa, ARTIFICIAL SEQUENCE
  Engineered FcRn binding polypeptide
ENQGAAHEIRWLPNLTWDQRVAFIRKLQD

SEQ ID NO: 11 - protein, 29 aa, ARTIFICIAL SEQUENCE
  Engineered FcRn binding polypeptide
ERTQASHEIRWLPNLTYDQRVAFINKLRD

SEQ ID NO: 12 - protein, 29 aa, ARTIFICIAL SEQUENCE
  Engineered FcRn binding polypeptide
ERKDAGHEIRWLPNLTFDQRSAFIKKLED

SEQ ID NO: 13 - protein, 29 aa, ARTIFICIAL SEQUENCE
  Engineered FcRn binding polypeptide
ERQEAAHEIRWLPNLTFDQRVAFIVKLLD

SEQ ID NO: 14 - protein, 29 aa, ARTIFICIAL SEQUENCE
  Engineered FcRn binding polypeptide
EEDVAAHEIRWLPNLTFNQRAAFIDKLLD

SEQ ID NO: 15 - protein, 29 aa, ARTIFICIAL SEQUENCE
  Engineered FcRn binding polypeptide
ENQDAAHEIRWLPNLTYDQRVAFIGKLND

SEQ ID NO: 16 - protein, 29 aa, ARTIFICIAL SEQUENCE
  Engineered FcRn binding polypeptide
ESGYAVHEIRWLPNLTFDQRVAFINKLQD

SEQ ID NO: 17 - protein, 29 aa, ARTIFICIAL SEQUENCE
  Engineered FcRn binding polypeptide
ESKDAAHEIRWLPNLTFDQRVAFIHKLRD

SEQ ID NO: 18 - protein, 29 aa, ARTIFICIAL SEQUENCE
  Engineered FcRn binding polypeptide
EKKEAAHEIRWLPNLTFDQRVAFIHKLRD

SEQ ID NO: 19 - protein, 29 aa, ARTIFICIAL SEQUENCE
  Engineered FcRn binding polypeptide
EWHQAAHEIRWLPNLTFDQRVAFIHKLRD

SEQ ID NO: 20 - protein, 29 aa, ARTIFICIAL SEQUENCE
  Engineered FcRn binding polypeptide
EWTDAAHEIRWLPNLTFDQRVAFIHKLRD

SEQ ID NO: 21 - protein, 29 aa, ARTIFICIAL SEQUENCE
  Engineered FcRn binding polypeptide
EISAASHEIRWLPNLTFDQRVAFIHKLRD

SEQ ID NO: 22 - protein, 29 aa, ARTIFICIAL SEQUENCE
  Engineered FcRn binding polypeptide
EQQAAAHEIRWLPNLTFDQRVAFIHKLRD

SEQ ID NO: 23 - protein, 29 aa, ARTIFICIAL SEQUENCE
  Engineered FcRn binding polypeptide
ELEKAGHEIRWLPNLTFDQRVAFIHKLRD

SEQ ID NO: 24 - protein, 29 aa, ARTIFICIAL SEQUENCE
  Engineered FcRn binding polypeptide
EYLDAAHEIRWLPNLTFDQRVAFIHKLRD

SEQ ID NO: 25 - protein, 29 aa, ARTIFICIAL SEQUENCE
  Engineered FcRn binding polypeptide
ELKDAGHEIRWLPNLTFDQRVAFIHKLRD

SEQ ID NO: 26 - protein, 29 aa, ARTIFICIAL SEQUENCE
  Engineered FcRn binding polypeptide
EHVDAAHEIRWLPNLTFDQRVAFIHKLRD

SEQ ID NO: 27 - protein, 29 aa, ARTIFICIAL SEQUENCE
  Engineered FcRn binding polypeptide
EYAAAAHEIRWLPNLTFDQRVAFIHKLRD

SEQ ID NO: 28 - protein, 29 aa, ARTIFICIAL SEQUENCE
  Engineered FcRn binding polypeptide
EVDIAAHEIRWLPNLTFDQRVAFIHKLRD

SEQ ID NO: 29 - protein, 29 aa, ARTIFICIAL SEQUENCE
  Engineered FcRn binding polypeptide
EIDEAKHEIRWLPNLTFDQRVAFIHKLDD

SEQ ID NO: 30 - protein, 29 aa, ARTIFICIAL SEQUENCE
  Engineered FcRn binding polypeptide
ELRQAGHEIRWLPNLTFDQRVAFIHKLRD

SEQ ID NO: 31 - protein, 29 aa, ARTIFICIAL SEQUENCE
  Engineered FcRn binding polypeptide
ELQSAAHEIRWLPNLTFDQRVAFIHKLKD

SEQ ID NO: 32 - protein, 29 aa, ARTIFICIAL SEQUENCE
  Engineered FcRn binding polypeptide
ELEKAAHEIRWLPNLTFDQRVAFIHKLRD

SEQ ID NO: 33 - protein, 29 aa, ARTIFICIAL SEQUENCE
  Engineered FcRn binding polypeptide
EAHEAAHEIRWLPNLTFDQRVAFIHKLRD

SEQ ID NO: 34 - protein, 29 aa, ARTIFICIAL SEQUENCE
  Engineered FcRn binding polypeptide
ELQAASHEIRWLPNLTFDQRVAFIHKLRD

SEQ ID NO: 35 - protein, 29 aa, ARTIFICIAL SEQUENCE
  Engineered FcRn binding polypeptide
EIESAKHEIRWLPNLTFDQRVAFIHKLND

SEQ ID NO: 36 - protein, 29 aa, ARTIFICIAL SEQUENCE
  Engineered FcRn binding polypeptide
EWKVAAHEIRWLPNLTFDQRVAFIHKLRD

SEQ ID NO: 37 - protein, 29 aa, ARTIFICIAL SEQUENCE
  Engineered FcRn binding polypeptide
EWKAAAHEIRWLPNLTFDQRVAFIHKLRD

SEQ ID NO: 38 - protein, 29 aa, ARTIFICIAL SEQUENCE
  Engineered FcRn binding polypeptide
EIDLAKHEIRWLPNLTFDQRVAFIHKLDD

SEQ ID NO: 39 - protein, 29 aa, ARTIFICIAL SEQUENCE
  Engineered FcRn binding polypeptide
ELEAARHEIRWLPNLTFDQRVAFIHKLND

SEQ ID NO: 40 - protein, 29 aa, ARTIFICIAL SEQUENCE
  Engineered FcRn binding polypeptide
EAATAGHEIRWLPNLTFDQRVAFIHKLRD

SEQ ID NO: 41 - protein, 29 aa, ARTIFICIAL SEQUENCE
  Engineered FcRn binding polypeptide
EWQQAAHEIRWLPNLTFDQRVAFIHKLRD

SEQ ID NO: 42 - protein, 29 aa, ARTIFICIAL SEQUENCE
  Engineered FcRn binding polypeptide
EADQAGHEIRWLPNLTFDQRVAFIRKLRD

SEQ ID NO: 43 - protein, 29 aa, ARTIFICIAL SEQUENCE
  Engineered FcRn binding polypeptide
EQSKAAHEIRWLPNLTFDQRVAFIHKLRD

SEQ ID NO: 44 - protein, 29 aa, ARTIFICIAL SEQUENCE
  Engineered FcRn binding polypeptide
EADAAGHEIRWLPNLTFDQRVAFIHKLRD

SEQ ID NO: 45 - protein, 29 aa, ARTIFICIAL SEQUENCE
  Engineered FcRn binding polypeptide
EFMDAGHEIRWLPNLTFDQRVAFIHKLRD

SEQ ID NO: 46 - protein, 29 aa, ARTIFICIAL SEQUENCE
  Engineered FcRn binding polypeptide
ESKQAAHEIRWLPNLTFDQRVAFIHKLRD

SEQ ID NO: 47 - protein, 29 aa, ARTIFICIAL SEQUENCE
  Engineered FcRn binding polypeptide
EVSDAAHEIRWLPNLTFDQRVAFIHKLRD

SEQ ID NO: 48 - protein, 29 aa, ARTIFICIAL SEQUENCE
  Engineered FcRn binding polypeptide
EADSASHEIRWLPNLTFDQRVAFIHKLRD

SEQ ID NO: 49 - protein, 29 aa, ARTIFICIAL SEQUENCE
  Engineered FcRn binding polypeptide
ELMEAAHEIRWLPNLTFDQRVAFIHKLRD

SEQ ID NO: 50 - protein, 29 aa, ARTIFICIAL SEQUENCE
  Engineered FcRn binding polypeptide
ELNTAAHEIRWLPNLTFDQRVAFIHKLKD

SEQ ID NO: 51 - protein, 29 aa, ARTIFICIAL SEQUENCE
  Engineered FcRn binding polypeptide
EVHEAGHEIRWLPNLTFDQRVAFIHKLRD

SEQ ID NO: 52 - protein, 29 aa, ARTIFICIAL SEQUENCE
  Engineered FcRn binding polypeptide
ESTAAAHEIRWLPNLTFDQRVAFIHKLRD

SEQ ID NO: 53 - protein, 29 aa, ARTIFICIAL SEQUENCE
  Engineered FcRn binding polypeptide
EWYNAAHEIRWLPNLTFDQRVAFIHKLRD

SEQ ID NO: 54 - protein, 29 aa, ARTIFICIAL SEQUENCE
  Engineered FcRn binding polypeptide
EWNDAAHEIRWLPNLTFDQRVAFIHKLRD

SEQ ID NO: 55 - protein, 29 aa, ARTIFICIAL SEQUENCE
  Engineered FcRn binding polypeptide
EVEVAKHEIRWLPNLTFDQRVAFIHKLDD

SEQ ID NO: 56 - protein, 29 aa, ARTIFICIAL SEQUENCE
  Engineered FcRn binding polypeptide
EFNFAAHEIRWLPNLTFDQRVAFIHKLRD

SEQ ID NO: 57 - protein, 29 aa, ARTIFICIAL SEQUENCE
  Engineered FcRn binding polypeptide
EHDSAAHEIRWLPNLTFDQRVAFIHKLRD

SEQ ID NO: 58 - protein, 29 aa, ARTIFICIAL SEQUENCE
  Engineered FcRn binding polypeptide
EWMDAAHEIRWLPNLTFDQRVAFIHKLRD

SEQ ID NO: 59 - protein, 29 aa, ARTIFICIAL SEQUENCE
  Engineered FcRn binding polypeptide
EFSAAGHEIRWLPNLTFDQRVAFIHKLRD

SEQ ID NO: 60 - protein, 29 aa, ARTIFICIAL SEQUENCE
  Engineered FcRn binding polypeptide
ELNSAAHEIRWLPNLTFDQRVAFIHKLRD

SEQ ID NO: 61 - protein, 29 aa, ARTIFICIAL SEQUENCE
  Engineered FcRn binding polypeptide
EVDTAAHEIRWLPNLTFDQRVAFIHKLRD

SEQ ID NO: 62 - protein, 29 aa, ARTIFICIAL SEQUENCE
  Engineered FcRn binding polypeptide
ESQIAGHEIRWLPNLTFDQRVAFIHKLRD

SEQ ID NO: 63 - protein, 29 aa, ARTIFICIAL SEQUENCE
  Engineered FcRn binding polypeptide
EVSAASHEIRWLPNLTFDQRVAFIHKLRD

SEQ ID NO: 64 - protein, 29 aa, ARTIFICIAL SEQUENCE
  Engineered FcRn binding polypeptide
EDQDAAHEIRWLPNLTFDQRVAFIHKLRD

SEQ ID NO: 65 - protein, 29 aa, ARTIFICIAL SEQUENCE
  Engineered FcRn binding polypeptide
ELEAAKHEIRWLPNLTFDQRVAFIHKLDD

SEQ ID NO: 66 - protein, 29 aa, ARTIFICIAL SEQUENCE
  Engineered FcRn binding polypeptide
ESKRAAHEIRWLPNLTFDQRVAFIHKLRD

SEQ ID NO: 67 - protein, 29 aa, ARTIFICIAL SEQUENCE
  Engineered FcRn binding polypeptide
EYVKAGHEIRWLPNLTFDQRVAFIRKLRD

SEQ ID NO: 68 - protein, 29 aa, ARTIFICIAL SEQUENCE
  Engineered FcRn binding polypeptide
EFSRAGHEIRWLPNLTFDQRVAFIHKLRD

SEQ ID NO: 69 - protein, 29 aa, ARTIFICIAL SEQUENCE
  Engineered FcRn binding polypeptide
EWQFAAHEIRWLPNLTFDQRVAFIHKLRD

SEQ ID NO: 70 - protein, 29 aa, ARTIFICIAL SEQUENCE
  Engineered FcRn binding polypeptide
EWQIAAHEIRWLPNLTFDQRVAFIHKLRD

SEQ ID NO: 71 - protein, 29 aa, ARTIFICIAL SEQUENCE
  Engineered FcRn binding polypeptide
ELQEAAHEIRWLPNLTFDQRVAFIHKLRD

SEQ ID NO: 72 - protein, 29 aa, ARTIFICIAL SEQUENCE
  Engineered FcRn binding polypeptide
EYRAAAHEIRWLPNLTFDQRVAFIHKLRD

SEQ ID NO: 73 - protein, 29 aa, ARTIFICIAL SEQUENCE
  Engineered FcRn binding polypeptide
ELASAGHEIRWLPNLTFDQRVAFIHKLRD

SEQ ID NO: 74 - protein, 29 aa, ARTIFICIAL SEQUENCE
  Engineered FcRn binding polypeptide
EVQSASHEIRWLPNLTFDQRVAFIHKLRD

SEQ ID NO: 75 - protein, 29 aa, ARTIFICIAL SEQUENCE
  Engineered FcRn binding polypeptide
EIEDAGHEIRWLPNLTFDQRVAFIHKLRD

SEQ ID NO: 76 - protein, 29 aa, ARTIFICIAL SEQUENCE
  Engineered FcRn binding polypeptide
ENQAAAHEIRWLPNLTFDQRVAFIHKLRD

SEQ ID NO: 77 - protein, 29 aa, ARTIFICIAL SEQUENCE
  Engineered FcRn binding polypeptide
EATSAGHEIRWLPNLTFDQRVAFIVKLRD

SEQ ID NO: 78 - protein, 29 aa, ARTIFICIAL SEQUENCE
  Engineered FcRn binding polypeptide
EDEQAAHEIRWLPNLTFDQRVAFIHKLRD

SEQ ID NO: 79 - protein, 29 aa, ARTIFICIAL SEQUENCE
  Engineered FcRn binding polypeptide
EQNQAGHEIRWLPNLTFDQRVAFIHKLRD

SEQ ID NO: 80 - protein, 29 aa, ARTIFICIAL SEQUENCE
  Engineered FcRn binding polypeptide
EYTSAAHEIRWLPNLTFDQRVAFIHKLRD

SEQ ID NO: 81 - protein, 29 aa, ARTIFICIAL SEQUENCE
  Engineered FcRn binding polypeptide
EWDAAAHEIRWLPNLTFDQRVAFIHKLRD

SEQ ID NO: 82 - protein, 29 aa, ARTIFICIAL SEQUENCE
  Engineered FcRn binding polypeptide
EEMQAGHEIRWLPNLTFDQRVAFIHKLRD

SEQ ID NO: 83 - protein, 29 aa, ARTIFICIAL SEQUENCE
  Engineered FcRn binding polypeptide
ELSDAAHEIRWLPNLTFDQRVAFIHKLND

SEQ ID NO: 84 - protein, 29 aa, ARTIFICIAL SEQUENCE
  Engineered FcRn binding polypeptide
EIDAAKHEIRWLPNLTFDQRVAFIHKLDD

SEQ ID NO: 85 - protein, 29 aa, ARTIFICIAL SEQUENCE
  Engineered FcRn binding polypeptide
EAERAGHEIRWLPNLTFDQRVAFIRKLRD

SEQ ID NO: 86 - protein, 29 aa, ARTIFICIAL SEQUENCE
  Engineered FcRn binding polypeptide
EEDSAAHEIRWLPNLTFDQRVAFIHKLKD

SEQ ID NO: 87 - protein, 29 aa, ARTIFICIAL SEQUENCE
  Engineered FcRn binding polypeptide
EQKAAGHEIRWLPNLTFDQRVAFIHKLRD

SEQ ID NO: 88 - protein, 29 aa, ARTIFICIAL SEQUENCE
  Engineered FcRn binding polypeptide
EWDQAAHEIRWLPNLTFDQRVAFIHKLRD

SEQ ID NO: 89 - protein, 29 aa, ARTIFICIAL SEQUENCE
  Engineered FcRn binding polypeptide
EAKAAAHEIRWLPNLTFDQRVAFIHKLRD

SEQ ID NO: 90 - protein, 29 aa, ARTIFICIAL SEQUENCE
  Engineered FcRn binding polypeptide
ELSEAAHEIRWLPNLTFDQRVAFIHKLKD

SEQ ID NO: 91 - protein, 29 aa, ARTIFICIAL SEQUENCE
  Engineered FcRn binding polypeptide
ETEAAKHEIRWLPNLTFDQRVAFIHKLDD

SEQ ID NO: 92 - protein, 29 aa, ARTIFICIAL SEQUENCE
  Engineered FcRn binding polypeptide
EAKSAAHEIRWLPNLTFDQRVAFIHKLRD

SEQ ID NO: 93 - protein, 29 aa, ARTIFICIAL SEQUENCE
  Engineered FcRn binding polypeptide
EQSAAAHEIRWLPNLTFDQRVAFIHKLND

SEQ ID NO: 94 - protein, 29 aa, ARTIFICIAL SEQUENCE
  Engineered FcRn binding polypeptide
EKERAAHEIRWLPNLTFDQRVAFIHKLRD

SEQ ID NO: 95 - protein, 29 aa, ARTIFICIAL SEQUENCE
  Engineered FcRn binding polypeptide
EWDEAAHEIRWLPNLTFDQRVAFIHKLKD

SEQ ID NO: 96 - protein, 29 aa, ARTIFICIAL SEQUENCE
  Engineered FcRn binding polypeptide
EEKDAAHEIRWLPNLTFDQRVAFIHKLRD

SEQ ID NO: 97 - protein, 29 aa, ARTIFICIAL SEQUENCE
  Engineered FcRn binding polypeptide
EIENAAHEIRWLPNLTFDQRVAFIWKLRD

SEQ ID NO: 98 - protein, 29 aa, ARTIFICIAL SEQUENCE
  Engineered FcRn binding polypeptide
ETKEAAHEIRWLPNLTFDQRVAFIHKLWD

SEQ ID NO: 99 - protein, 29 aa, ARTIFICIAL SEQUENCE
  Engineered FcRn binding polypeptide
ELEAAKHEIRWLPNLTFDQRVAFIHKLND

SEQ ID NO: 100 - protein, 29 aa, ARTIFICIAL SEQUENCE
  Engineered FcRn binding polypeptide
EWAEAAHEIRWLPNLTFDQRVAFIHKLRD

SEQ ID NO: 101 - protein, 29 aa, ARTIFICIAL SEQUENCE
  Engineered FcRn binding polypeptide
ESQEAGHEIRWLPNLTFDQRVAFIHKLRD

SEQ ID NO: 102 - protein, 29 aa, ARTIFICIAL SEQUENCE
  Engineered FcRn binding polypeptide
ELSTAAHEIRWLPNLTFDQRVAFIHKLRD

SEQ ID NO: 103 - protein, 29 aa, ARTIFICIAL SEQUENCE
  Engineered FcRn binding polypeptide
EIEEAGHEIRWLPNLTFDQRVAFIHKLRD

SEQ ID NO: 104 - protein, 29 aa, ARTIFICIAL SEQUENCE
  Engineered FcRn binding polypeptide
ELQTASHEIRWLPNLTFDQRVAFIHKLRD

SEQ ID NO: 105 - protein, 29 aa, ARTIFICIAL SEQUENCE
  Engineered FcRn binding polypeptide
EQDSAAHEIRWLPNLTFDQRVAFIRKLRD

SEQ ID NO: 106 - protein, 29 aa, ARTIFICIAL SEQUENCE
  Engineered FcRn binding polypeptide
ESASAGHEIRWLPNLTFDQRVAFIHKLRD

SEQ ID NO: 107 - protein, 29 aa, ARTIFICIAL SEQUENCE
  Engineered FcRn binding polypeptide
EVAKASHEIRWLPNLTFDQRVAFIHKLRD

SEQ ID NO: 108 - protein, 29 aa, ARTIFICIAL SEQUENCE
  Engineered FcRn binding polypeptide
EVQEAAHEIRWLPNLTFDQRVAFIHKLWD

SEQ ID NO: 109 - protein, 29 aa, ARTIFICIAL SEQUENCE
  Engineered FcRn binding polypeptide
ESYEAAHEIRWLPNLTFDQRVAFIHKLRD

SEQ ID NO: 110 - protein, 29 aa, ARTIFICIAL SEQUENCE
  Engineered FcRn binding polypeptide
ETAEAGHEIRWLPNLTFDQRVAFIHKLRD

SEQ ID NO: 111 - protein, 29 aa, ARTIFICIAL SEQUENCE
  Engineered FcRn binding polypeptide
ELEEAAHEIRWLPNLTFDQRVAFIHKLRD

SEQ ID NO: 112 - protein, 29 aa, ARTIFICIAL SEQUENCE
  Engineered FcRn binding polypeptide
EAAAAGHEIRWLPNLTFDQRVAFIHKLRD

SEQ ID NO: 113 - protein, 29 aa, ARTIFICIAL SEQUENCE
  Engineered FcRn binding polypeptide
EYVDAGHEIRWLPNLTFDQRVAFIRKLRD

SEQ ID NO: 114 - protein, 29 aa, ARTIFICIAL SEQUENCE
  Engineered FcRn binding polypeptide
EIQEAGHEIRWLPNLTFDQRVAFIHKLRD

SEQ ID NO: 115 - protein, 29 aa, ARTIFICIAL SEQUENCE
  Engineered FcRn binding polypeptide
ESATAAHEIRWLPNLTFDQRVAFIHKLRD

SEQ ID NO: 116 - protein, 29 aa, ARTIFICIAL SEQUENCE
  Engineered FcRn binding polypeptide
EWMSAAHEIRWLPNLTFDQRVAFIHKLRD

SEQ ID NO: 117 - protein, 29 aa, ARTIFICIAL SEQUENCE
  Engineered FcRn binding polypeptide
EREQASHEIRWLPNLTFDQRVAFIHKLRD

SEQ ID NO: 118 - protein, 29 aa, ARTIFICIAL SEQUENCE
  Engineered FcRn binding polypeptide
EIEQAGHEIRWLPNLTFDQRVAFIHKLRD

SEQ ID NO: 119 - protein, 29 aa, ARTIFICIAL SEQUENCE
  Engineered FcRn binding polypeptide
EHNAAAHEIRWLPNLTFDQRVAFIHKLRD

SEQ ID NO: 120 - protein, 29 aa, ARTIFICIAL SEQUENCE
  Engineered FcRn binding polypeptide
EIEVAAHEIRWLPNLTFDQRVAFIHKLRD

SEQ ID NO: 121 - protein, 29 aa, ARTIFICIAL SEQUENCE
  Engineered FcRn binding polypeptide
ERAEAAHEIRWLPNLTFDQRVAFIHKLRD

SEQ ID NO: 122 - protein, 29 aa, ARTIFICIAL SEQUENCE
  Engineered FcRn binding polypeptide
ESELAAHEIRWLPNLTFDQRVAFIWKLRD

SEQ ID NO: 123 - protein, 29 aa, ARTIFICIAL SEQUENCE
  Engineered FcRn binding polypeptide
EYRAAGHEIRWLPNLTFDQRVAFIHKLRD

SEQ ID NO: 124 - protein, 29 aa, ARTIFICIAL SEQUENCE
  Engineered FcRn binding polypeptide
ETANAAHEIRWLPNLTFDQRVAFIHKLRD

SEQ ID NO: 125 - protein, 29 aa, ARTIFICIAL SEQUENCE
  Engineered FcRn binding polypeptide
EWYEAAHEIRWLPNLTFDQRVAFIHKLRD

SEQ ID NO: 126 - protein, 29 aa, ARTIFICIAL SEQUENCE
  Engineered FcRn binding polypeptide
EEQEAAHEIRWLPNLTFDQRVAFIHKLWD

SEQ ID NO: 127 - protein, 29 aa, ARTIFICIAL SEQUENCE
  Engineered FcRn binding polypeptide
EHDDAAHEIRWLPNLTFDQRVAFIHKLRD

SEQ ID NO: 128 - protein, 29 aa, ARTIFICIAL SEQUENCE
  Engineered FcRn binding polypeptide
EWYSAAHEIRWLPNLTFDQRVAFIHKLRD

SEQ ID NO: 129 - protein, 29 aa, ARTIFICIAL SEQUENCE
  Engineered FcRn binding polypeptide
EISDAAHEIRWLPNLTFDQRVAFIHKLRD

SEQ ID NO: 130 - protein, 29 aa, ARTIFICIAL SEQUENCE
  Engineered FcRn binding polypeptide
EYTTAAHEIRWLPNLTFDQRVAFIHKLRD

SEQ ID NO: 131 - protein, 29 aa, ARTIFICIAL SEQUENCE
  Engineered FcRn binding polypeptide
EISQAAHEIRWLPNLTFDQRVAFIHKLRD

SEQ ID NO: 132 - protein, 29 aa, ARTIFICIAL SEQUENCE
  Engineered FcRn binding polypeptide
ENDDAAHEIRWLPNLTFDQRVAFIHKLRD

SEQ ID NO: 133 - protein, 29 aa, ARTIFICIAL SEQUENCE
  Engineered FcRn binding polypeptide
ESEIAGHEIRWLPNLTFDQRVAFIRKLRD

SEQ ID NO: 134 - protein, 29 aa, ARTIFICIAL SEQUENCE
  Engineered FcRn binding polypeptide
EQADAAHEIRWLPNLTFDQRVAFIHKLRD

SEQ ID NO: 135 - protein, 29 aa, ARTIFICIAL SEQUENCE
  Engineered FcRn binding polypeptide
ETESAAHEIRWLPNLTFDQRVAFIHKLRD

SEQ ID NO: 136 - protein, 29 aa, ARTIFICIAL SEQUENCE
  Engineered FcRn binding polypeptide
EISDAKHEIRWLPNLTFDQRVAFIHKLDD

SEQ ID NO: 137 - protein, 29 aa, ARTIFICIAL SEQUENCE
  Engineered FcRn binding polypeptide
EHLNAAHEIRWLPNLTFDQRVAFIHKLRD

SEQ ID NO: 138 - protein, 29 aa, ARTIFICIAL SEQUENCE
  Engineered FcRn binding polypeptide
EWLDAAHEIRWLPNLTFDQRVAFIHKLRD

SEQ ID NO: 139 - protein, 29 aa, ARTIFICIAL SEQUENCE
  Engineered FcRn binding polypeptide
ENAAAAHEIRWLPNLTFDQRVAFIHKLRD

SEQ ID NO: 140 - protein, 29 aa, ARTIFICIAL SEQUENCE
  Engineered FcRn binding polypeptide
EAELAGHEIRWLPNLTFDQRVAFIRKLRD

SEQ ID NO: 141 - protein, 29 aa, ARTIFICIAL SEQUENCE
  Engineered FcRn binding polypeptide
EVTDAGHEIRWLPNLTFDQRVAFIEKLKD

SEQ ID NO: 142 - protein, 29 aa, ARTIFICIAL SEQUENCE
  Engineered FcRn binding polypeptide
ELDSASHEIRWLPNLTFDQRVAFINKLLD

SEQ ID NO: 143 - protein, 29 aa, ARTIFICIAL SEQUENCE
  Engineered FcRn binding polypeptide
EINLAKHEIRWLPNLTFDQRVAFIEKLND

SEQ ID NO: 144 - protein, 29 aa, ARTIFICIAL SEQUENCE
  Engineered FcRn binding polypeptide
ESEVAKHEIRWLPNLTFDQRVAFIHKLSD

SEQ ID NO: 145 - protein, 29 aa, ARTIFICIAL SEQUENCE
  Engineered FcRn binding polypeptide
ESAEAGHEIRWLPNLTFDQRVAFIHKLQD

SEQ ID NO: 146 - protein, 29 aa, ARTIFICIAL SEQUENCE
  Engineered FcRn binding polypeptide
EYSNAAHEIRWLPNLTFDQRVAFIDKLSD

SEQ ID NO: 147 - protein, 29 aa, ARTIFICIAL SEQUENCE
  Engineered FcRn binding polypeptide
ETNNAGHEIRWLPNLTFDQRVAFIIKLRD

SEQ ID NO: 148 - protein, 29 aa, ARTIFICIAL SEQUENCE
  Engineered FcRn binding polypeptide
EVEFAAHEIRWLPNLTFDQRVAFIHKLND

SEQ ID NO: 149 - protein, 29 aa, ARTIFICIAL SEQUENCE
  Engineered FcRn binding polypeptide
EVELAGHEIRWLPNLTFDQRVAFIEKLHD

SEQ ID NO: 150 - protein, 29 aa, ARTIFICIAL SEQUENCE
  Engineered FcRn binding polypeptide
EVLKASHEIRWLPNLTFDQRVAFITKLQD

SEQ ID NO: 151 - protein, 29 aa, ARTIFICIAL SEQUENCE
  Engineered FcRn binding polypeptide
EIANAGHEIRWLPNLTFDQRVAFIRKLDD

SEQ ID NO: 152 - protein, 29 aa, ARTIFICIAL SEQUENCE
  Engineered FcRn binding polypeptide
EYMKAGHEIRWLPNLTFDQRVAFIVKLRD

SEQ ID NO: 153 - protein, 29 aa, ARTIFICIAL SEQUENCE
  Engineered FcRn binding polypeptide
EHANAQHEIRWLPNLTFDQRVAFIHKLQD

SEQ ID NO: 154 - protein, 29 aa, ARTIFICIAL SEQUENCE
  Engineered FcRn binding polypeptide
EVDIASHEIRWLPNLTYDQRVAFIWKLRD

SEQ ID NO: 155 - protein, 29 aa, ARTIFICIAL SEQUENCE
  Engineered FcRn binding polypeptide
EEVFAAHEIRWLPNLTYDQRVAFIVKLRD

SEQ ID NO: 156 - protein, 29 aa, ARTIFICIAL SEQUENCE
  Engineered FcRn binding polypeptide
EFNTAAHEIRWLPNLTFDQRVAFINKLDD

SEQ ID NO: 157 - protein, 29 aa, ARTIFICIAL SEQUENCE
  Engineered FcRn binding polypeptide
EVDVAGHEIRWLPNLTFDQRVAFIRKLND

SEQ ID NO: 158 - protein, 29 aa, ARTIFICIAL SEQUENCE
  Engineered FcRn binding polypeptide
EWSLAAHEIRWLPNLTFDQRVAFIVKLRD

SEQ ID NO: 159 - protein, 29 aa, ARTIFICIAL SEQUENCE
  Engineered FcRn binding polypeptide
ELDDAAHEIRWLPNLTFDQRVAFIQKLQD

SEQ ID NO: 160 - protein, 29 aa, ARTIFICIAL SEQUENCE
  Engineered FcRn binding polypeptide
ERHEAGHEIRWLPNLTFDQRVAFIRKLND

SEQ ID NO: 161 - protein, 29 aa, ARTIFICIAL SEQUENCE
  Engineered FcRn binding polypeptide
EISDAIHEIRWLPNLTFDQRVAFIHKLQD

SEQ ID NO: 162 - protein, 29 aa, ARTIFICIAL SEQUENCE
  Engineered FcRn binding polypeptide
EWETAGHEIRWLPNLTFDQRVAFIVKLSD

SEQ ID NO: 163 - protein, 29 aa, ARTIFICIAL SEQUENCE
  Engineered FcRn binding polypeptide
ERYWASHEIRWLPNLTFDQRVAFIHKLND

SEQ ID NO: 164 - protein, 29 aa, ARTIFICIAL SEQUENCE
  Engineered FcRn binding polypeptide
EIDWAGHEIRWLPNLTFDQRVAFIHKLLD

SEQ ID NO: 165 - protein, 29 aa, ARTIFICIAL SEQUENCE
  Engineered FcRn binding polypeptide
EQSKAGHEIRWLPNLTFDQRVAFIHKLKD

SEQ ID NO: 166 - protein, 29 aa, ARTIFICIAL SEQUENCE
  Engineered FcRn binding polypeptide
EIEAAQHEIRWLPNLTFDQRVAFINKLRD

SEQ ID NO: 167 - protein, 29 aa, ARTIFICIAL SEQUENCE
  Engineered FcRn binding polypeptide
EHEQAAHEIRWLPNLTFDQRVAFIRKLVD

SEQ ID NO: 168 - protein, 29 aa, ARTIFICIAL SEQUENCE
  Engineered FcRn binding polypeptide
EAEQAGHEIRWLPNLTFDQRVAFINKLQD

SEQ ID NO: 169 - protein, 29 aa, ARTIFICIAL SEQUENCE
  Engineered FcRn binding polypeptide
EVDYAAHEIRWLPNLTFDQRVAFIHKLWD

SEQ ID NO: 170 - protein, 29 aa, ARTIFICIAL SEQUENCE
  Engineered FcRn binding polypeptide
EYSAAGHEIRWLPNLTFDQRVAFIEKLRD

SEQ ID NO: 171 - protein, 29 aa, ARTIFICIAL SEQUENCE
  Engineered FcRn binding polypeptide
ELATASHEIRWLPNLTFDQRVAFIHKLRD

SEQ ID NO: 172 - protein, 29 aa, ARTIFICIAL SEQUENCE
  Engineered FcRn binding polypeptide
EYRVAGHEIRWLPNLTFDQRVAFIQKLRD

SEQ ID NO: 173 - protein, 29 aa, ARTIFICIAL SEQUENCE
  Engineered FcRn binding polypeptide
EVVSAKHEIRWLPNLTFDQRVAFIHKLDD

SEQ ID NO: 174 - protein, 29 aa, ARTIFICIAL SEQUENCE
  Engineered FcRn binding polypeptide
ESAQAAHEIRWLPNLTFDQRVAFIRKLRD

SEQ ID NO: 175 - protein, 29 aa, ARTIFICIAL SEQUENCE
  Engineered FcRn binding polypeptide
EYSAAGHEIRWLPNLTFDQRVAFIHKLRD

SEQ ID NO: 176 - protein, 29 aa, ARTIFICIAL SEQUENCE
  Engineered FcRn binding polypeptide
EQKEAAAEIRWLPNLTFDQRVAFIHKLRD

SEQ ID NO: 177 - protein, 29 aa, ARTIFICIAL SEQUENCE
  Engineered FcRn binding polypeptide
EAAIAGKEIRWLPNLTFDQRVAFIHKLRD

SEQ ID NO: 178 - protein, 29 aa, ARTIFICIAL SEQUENCE
  Engineered FcRn binding polypeptide
EISKAKHEIRWLPNLTFDQRVAFIHKLDD

SEQ ID NO: 179 - protein, 29 aa, ARTIFICIAL SEQUENCE
  Engineered FcRn binding polypeptide
ESVAAAHEIRWLPNLTFDQRVAFIWKLRD

SEQ ID NO: 180 - protein, 29 aa, ARTIFICIAL SEQUENCE
  Engineered FcRn binding polypeptide
EIQQAKHEIRWLPNLTFDQRVAFIHKLDD

SEQ ID NO: 181 - protein, 29 aa, ARTIFICIAL SEQUENCE
  Engineered FcRn binding polypeptide
EITSAKHEIRWLPNLTFDQRVAFIHKLDD

SEQ ID NO: 182 - protein, 29 aa, ARTIFICIAL SEQUENCE
  Engineered FcRn binding polypeptide
EQDVAAHEIRWLPNLTFDQRVAFIRKLRD

SEQ ID NO: 183 - protein, 29 aa, ARTIFICIAL SEQUENCE
  Engineered FcRn binding polypeptide
ELERAAHEIRWLPNLTFDQRVAFINKLKD

SEQ ID NO: 184 - protein, 29 aa, ARTIFICIAL SEQUENCE
  Engineered FcRn binding polypeptide
ENQLAAHEIRWLPNLTFDQRVAFIHKLRD

SEQ ID NO: 185 - protein, 29 aa, ARTIFICIAL SEQUENCE
  Engineered FcRn binding polypeptide
EISQAKHEIRWLPNLTFDQRVAFIHKLDD

SEQ ID NO: 186 - protein, 29 aa, ARTIFICIAL SEQUENCE
  Engineered FcRn binding polypeptide
EIANASHEIRWLPNLTFDQRVAFIYKLRD

SEQ ID NO: 187 - protein, 29 aa, ARTIFICIAL SEQUENCE
  Engineered FcRn binding polypeptide
EWQAAAHEIRWLPNLTFDQRVAFIRKLRD

SEQ ID NO: 188 - protein, 29 aa, ARTIFICIAL SEQUENCE
  Engineered FcRn binding polypeptide
ERKDAGHEIRWLPNLTFDQRVAFIRKLRD

SEQ ID NO: 189 - protein, 29 aa, ARTIFICIAL SEQUENCE
  Engineered FcRn binding polypeptide
EITQAKHEIRWLPNLTFDQRVAFIHKLDD

SEQ ID NO: 190 - protein, 29 aa, ARTIFICIAL SEQUENCE
  Engineered FcRn binding polypeptide
EFIQAGHEIRWLPNLTFDQRVAFIHKLRD

SEQ ID NO: 191 - protein, 29 aa, ARTIFICIAL SEQUENCE
  Engineered FcRn binding polypeptide
EWNTASHEIRWLPNLTFDQRVAFIHKLRD

SEQ ID NO: 192 - protein, 29 aa, ARTIFICIAL SEQUENCE
  Engineered FcRn binding polypeptide
EKFVAAHEIRWLPNLTFDQRVAFIHKLKD

SEQ ID NO: 193 - protein, 29 aa, ARTIFICIAL SEQUENCE
  Engineered FcRn binding polypeptide
EADSAGAEIRWLPNLTFDQRVAFIHKLRD

SEQ ID NO: 194 - protein, 29 aa, ARTIFICIAL SEQUENCE
  Engineered FcRn binding polypeptide
ESSVAAAEIRWLPNLTFDQRVAFIHKLRD

SEQ ID NO: 195 - protein, 29 aa, ARTIFICIAL SEQUENCE
  Engineered FcRn binding polypeptide
EVDLAGREIRWLPNLTFDQRVAFIHKLRD

SEQ ID NO: 196 - protein, 29 aa, ARTIFICIAL SEQUENCE
  Engineered FcRn binding polypeptide
EQERAAAEIRWLPNLTFDQRVAFIHKLRD

SEQ ID NO: 197 - protein, 29 aa, ARTIFICIAL SEQUENCE
  Engineered FcRn binding polypeptide
EIWQAKHEIRWLPNLTFDQRVAFIHKLDD

SEQ ID NO: 198 - protein, 29 aa, ARTIFICIAL SEQUENCE
  Engineered FcRn binding polypeptide
ELNQAKHEIRWLPNLTFDQRVAFIHKLED

SEQ ID NO: 199 - protein, 29 aa, ARTIFICIAL SEQUENCE
  Engineered FcRn binding polypeptide
ELQQASHEIRWLPNLTFDQRVAFIHKLRD

SEQ ID NO: 200 - protein, 29 aa, ARTIFICIAL SEQUENCE
  Engineered FcRn binding polypeptide
EINQAKHEIRWLPNLTFDQRVAFIHKLDD

SEQ ID NO: 201 - protein, 29 aa, ARTIFICIAL SEQUENCE
  Engineered FcRn binding polypeptide
ELVLAGHEIRWLPNLTFDQRVAFIHKLRD

SEQ ID NO: 202 - protein, 29 aa, ARTIFICIAL SEQUENCE
  Engineered FcRn binding polypeptide
ELTSAAHEIRWLPNLTFDQRVAFIHKLRD

SEQ ID NO: 203 - protein, 29 aa, ARTIFICIAL SEQUENCE
  Engineered FcRn binding polypeptide
EWNAAAREIRWLPNLTFDQRVAFIHKLRD

SEQ ID NO: 204 - protein, 29 aa, ARTIFICIAL SEQUENCE
  Engineered FcRn binding polypeptide
EILHAKHEIRWLPNLTFDQRVAFIHKLDD

SEQ ID NO: 205 - protein, 29 aa, ARTIFICIAL SEQUENCE
  Engineered FcRn binding polypeptide
EVLTAKHEIRWLPNLTFDQRVAFIHKLND

SEQ ID NO: 206 - protein, 29 aa, ARTIFICIAL SEQUENCE
  Engineered FcRn binding polypeptide
ENSKAAHEIRWLPNLTFDQRVAFIHKLAD

SEQ ID NO: 207 - protein, 29 aa, ARTIFICIAL SEQUENCE
  Engineered FcRn binding polypeptide
EVMTAKHEIRWLPNLTFDQRVAFIHKLDD

SEQ ID NO: 208 - protein, 29 aa, ARTIFICIAL SEQUENCE
  Engineered FcRn binding polypeptide
EARDAAHEIRWLPNLTFDQRVAFIHKLSD

SEQ ID NO: 209 - protein, 29 aa, ARTIFICIAL SEQUENCE
  Engineered FcRn binding polypeptide
ERSKAAHEIRWLPNLTFDQRVAFIHKLKD

SEQ ID NO: 210 - protein, 29 aa, ARTIFICIAL SEQUENCE
  Engineered FcRn binding polypeptide
EIYSAKHEIRWLPNLTFDQRVAFIHKLDD

SEQ ID NO: 211 - protein, 29 aa, ARTIFICIAL SEQUENCE
  Engineered FcRn binding polypeptide
EVQSAKHEIRWLPNLTFDQRVAFIHKLDD

SEQ ID NO: 212 - protein, 29 aa, ARTIFICIAL SEQUENCE
  Engineered FcRn binding polypeptide
ETLEAAHEIRWLPNLTFDQRVAFIHKLKD

SEQ ID NO: 213 - protein, 29 aa, ARTIFICIAL SEQUENCE
  Engineered FcRn binding polypeptide
EQMRAAHEIRWLPNLTFDQRVAFIRKLRD

SEQ ID NO: 214 - protein, 29 aa, ARTIFICIAL SEQUENCE
  Engineered FcRn binding polypeptide
ENKNAAHEIRWLPNLTFDQRVAFIHKLRD

SEQ ID NO: 215 - protein, 29 aa, ARTIFICIAL SEQUENCE
  Engineered FcRn binding polypeptide
ETESAKHEIRWLPNLTFDQRVAFIHKLTD

SEQ ID NO: 216 - protein, 29 aa, ARTIFICIAL SEQUENCE
  Engineered FcRn binding polypeptide
ETVQAKHEIRWLPNLTFDQRVAFIHKLDD

SEQ ID NO: 217 - protein, 29 aa, ARTIFICIAL SEQUENCE
  Engineered FcRn binding polypeptide
EIASAKHEIRWLPNLTFDQRVAFIHKLDD

SEQ ID NO: 218 - protein, 29 aa, ARTIFICIAL SEQUENCE
  Engineered FcRn binding polypeptide
EVMDAKHEIRWLPNLTFDQRVAFIHKLDD

SEQ ID NO: 219 - protein, 29 aa, ARTIFICIAL SEQUENCE
  Engineered FcRn binding polypeptide
ETDAAKHEIRWLPNLTFDQRVAFIHKLRD

SEQ ID NO: 220 - protein, 29 aa, ARTIFICIAL SEQUENCE
  Engineered FcRn binding polypeptide
ELQIAKHEIRWLPNLTFDQRVAFIHKLDD

SEQ ID NO: 221 - protein, 29 aa, ARTIFICIAL SEQUENCE
  Engineered FcRn binding polypeptide
EWKDAAQEIRWLPNLTFDQRVAFIHKLRD

SEQ ID NO: 222 - protein, 29 aa, ARTIFICIAL SEQUENCE
  Engineered FcRn binding polypeptide
ERDSAAHEIRWLPNLTFDQRVAFIRKLRD

SEQ ID NO: 223 - protein, 29 aa, ARTIFICIAL SEQUENCE
  Engineered FcRn binding polypeptide
EIAAAKHEIRWLPNLTFDQRVAFIHKLDD

SEQ ID NO: 224 - protein, 29 aa, ARTIFICIAL SEQUENCE
  Engineered FcRn binding polypeptide
ESVKAKHEIRWLPNLTFDQRVAFIHKLDD

SEQ ID NO: 225 - protein, 29 aa, ARTIFICIAL SEQUENCE
  Engineered FcRn binding polypeptide
ENERAKHEIRWLPNLTFDQRVAFIHKLDD

SEQ ID NO: 226 - protein, 29 aa, ARTIFICIAL SEQUENCE
  Engineered FcRn binding polypeptide
EYKRAGHEIRWLPNLTFDQRVAFIRKLRD

SEQ ID NO: 227 - protein, 29 aa, ARTIFICIAL SEQUENCE
  Engineered FcRn binding polypeptide
EVRAASHEIRWLPNLTFDQRVAFIHKLRD

SEQ ID NO: 228 - protein, 29 aa, ARTIFICIAL SEQUENCE
  Engineered FcRn binding polypeptide
EDKRAAHEIRWLPNLTFDQRVAFIRKLRD

SEQ ID NO: 229 - protein, 29 aa, ARTIFICIAL SEQUENCE
  Engineered FcRn binding polypeptide
ESEKAGKEIRWLPNLTFDQRVAFIRKLRD

SEQ ID NO: 230 - protein, 29 aa, ARTIFICIAL SEQUENCE
  Engineered FcRn binding polypeptide
EINRAKHEIRWLPNLTFDQRVAFIHKLDD

SEQ ID NO: 231 - protein, 29 aa, ARTIFICIAL SEQUENCE
  Engineered FcRn binding polypeptide
ETQQASHEIRWLPNLTFDQRVAFIHKLRD

SEQ ID NO: 232 - protein, 29 aa, ARTIFICIAL SEQUENCE
  Engineered FcRn binding polypeptide
ENQSAAHEIRWLPNLTFDQRVAFIRKLRD

SEQ ID NO: 233 - protein, 29 aa, ARTIFICIAL SEQUENCE
  Engineered FcRn binding polypeptide
EAKQASHEIRWLPNLTFDQRVAFIVKLRD

SEQ ID NO: 234 - protein, 29 aa, ARTIFICIAL SEQUENCE
  Engineered FcRn binding polypeptide
EAAQAAHEIRWLPNLTFDQRVAFIHKLRD

SEQ ID NO: 235 - protein, 29 aa, ARTIFICIAL SEQUENCE
  Engineered FcRn binding polypeptide
EVQYASHEIRWLPNLTFDQRVAFIHKLRD

SEQ ID NO: 236 - protein, 29 aa, ARTIFICIAL SEQUENCE
  Engineered FcRn binding polypeptide
ELRNAAHEIRWLPNLTFDQRVAFIHKLRD

SEQ ID NO: 237 - protein, 29 aa, ARTIFICIAL SEQUENCE
  Engineered FcRn binding polypeptide
EQRAAAHEIRWLPNLTFDQRVAFIHKLRD

SEQ ID NO: 238 - protein, 29 aa, ARTIFICIAL SEQUENCE
  Engineered FcRn binding polypeptide
EASEAAAEIRWLPNLTFDQRVAFIHKLRD

SEQ ID NO: 239 - protein, 29 aa, ARTIFICIAL SEQUENCE
  Engineered FcRn binding polypeptide
ESVIAAHEIRWLPNLTFDQRVAFIHKLRD

SEQ ID NO: 240 - protein, 29 aa, ARTIFICIAL SEQUENCE
  Engineered FcRn binding polypeptide
EILRAKHEIRWLPNLTFDQRVAFIHKLDD

SEQ ID NO: 241 - protein, 29 aa, ARTIFICIAL SEQUENCE
  Engineered FcRn binding polypeptide
ESKTAAHEIRWLPNLTFDQRVAFIQKLRD

SEQ ID NO: 242 - protein, 29 aa, ARTIFICIAL SEQUENCE
  Engineered FcRn binding polypeptide
ELAEASHEIRWLPNLTFDQRVAFIHKLFD

SEQ ID NO: 243 - protein, 29 aa, ARTIFICIAL SEQUENCE
  Engineered FcRn binding polypeptide
EATTAKHEIRWLPNLTFDQRVAFIHKLDD

SEQ ID NO: 244 - protein, 29 aa, ARTIFICIAL SEQUENCE
  Engineered FcRn binding polypeptide
EIENAAHEIRWLPNLTFDQRVAFIHKLRD

SEQ ID NO: 245 - protein, 29 aa, ARTIFICIAL SEQUENCE
  Engineered FcRn binding polypeptide
EAKDAAHEIRWLPNLTFDQRVAFIRKLRD

SEQ ID NO: 246 - protein, 29 aa, ARTIFICIAL SEQUENCE
  Engineered FcRn binding polypeptide
ERLEAAAEIRWLPNLTFDQRVAFIHKLRD

SEQ ID NO: 247 - protein, 29 aa, ARTIFICIAL SEQUENCE
  Engineered FcRn binding polypeptide
EQMEAAAEIRWLPNLTFDQRVAFIHKLRD

SEQ ID NO: 248 - protein, 29 aa, ARTIFICIAL SEQUENCE
  Engineered FcRn binding polypeptide
EVKTASHEIRWLPNLTFDQRVAFIRKLRD

SEQ ID NO: 249 - protein, 29 aa, ARTIFICIAL SEQUENCE
  Engineered FcRn binding polypeptide
ESFEASHEIRWLPNLTFDQRVAFIQKLRD

SEQ ID NO: 250 - protein, 29 aa, ARTIFICIAL SEQUENCE
  Engineered FcRn binding polypeptide
EIKSAKHEIRWLPNLTFDQRVAFIHKLDD

SEQ ID NO: 251 - protein, 29 aa, ARTIFICIAL SEQUENCE
  Engineered FcRn binding polypeptide
EIKNAKHEIRWLPNLTFDQRVAFIHKLDD

SEQ ID NO: 252 - protein, 29 aa, ARTIFICIAL SEQUENCE
  Engineered FcRn binding polypeptide
ELQEAKHEIRWLPNLTFDQRVAFIHKLDD

SEQ ID NO: 253 - protein, 29 aa, ARTIFICIAL SEQUENCE
  Engineered FcRn binding polypeptide
ERQNAAHEIRWLPNLTFDQRVAFIRKLRD

SEQ ID NO: 254 - protein, 29 aa, ARTIFICIAL SEQUENCE
  Engineered FcRn binding polypeptide
EVLQAKHEIRWLPNLTFDQRVAFIHKLDD

SEQ ID NO: 255 - protein, 29 aa, ARTIFICIAL SEQUENCE
  Engineered FcRn binding polypeptide
EANVASHEIRWLPNLTFDQRVAFIHKLRD

SEQ ID NO: 256 - protein, 29 aa, ARTIFICIAL SEQUENCE
  Engineered FcRn binding polypeptide
ELDAAKHEIRWLPNLTFDQRVAFIHKLDD

SEQ ID NO: 257 - protein, 29 aa, ARTIFICIAL SEQUENCE
  Engineered FcRn binding polypeptide
ETASAAHEIRWLPNLTFDQRVAFIHKLND

SEQ ID NO: 258 - protein, 29 aa, ARTIFICIAL SEQUENCE
  Engineered FcRn binding polypeptide
EWKQAASEIRWLPNLTFDQRVAFIHKLRD

SEQ ID NO: 259 - protein, 29 aa, ARTIFICIAL SEQUENCE
  Engineered FcRn binding polypeptide
ETASASHEIRWLPNLTFDQRVAFIHKLQD

SEQ ID NO: 260 - protein, 29 aa, ARTIFICIAL SEQUENCE
  Engineered FcRn binding polypeptide
ESIVAGHEIRWLPNLTFDQRVAFIHKLRD

SEQ ID NO: 261 - protein, 29 aa, ARTIFICIAL SEQUENCE
  Engineered FcRn binding polypeptide
EIKQAKHEIRWLPNLTFDQRVAFIHKLDD

SEQ ID NO: 262 - protein, 29 aa, ARTIFICIAL SEQUENCE
  Engineered FcRn binding polypeptide
EQATASHEIRWLPNLTFDQRVAFIRKLRD

SEQ ID NO: 263 - protein, 29 aa, ARTIFICIAL SEQUENCE
  Engineered FcRn binding polypeptide
ELNAAKHEIRWLPNLTFDQRVAFIHKLDD

SEQ ID NO: 264 - protein, 29 aa, ARTIFICIAL SEQUENCE
  Engineered FcRn binding polypeptide
EVKRAGHEIRWLPNLTFDQRVAFIRKLRD

SEQ ID NO: 265 - protein, 29 aa, ARTIFICIAL SEQUENCE
  Engineered FcRn binding polypeptide
ESRNAAHEIRWLPNLTFDQRVAFIHKLQD

SEQ ID NO: 266 - protein, 29 aa, ARTIFICIAL SEQUENCE
  Engineered FcRn binding polypeptide
ESITASAEIRWLPNLTFDQRVAFIRKLRD

SEQ ID NO: 267 - protein, 29 aa, ARTIFICIAL SEQUENCE
  Engineered FcRn binding polypeptide
EAATAAHEIRWLPNLTFDQRVAFIHKLQD

SEQ ID NO: 268 - protein, 29 aa, ARTIFICIAL SEQUENCE
  Engineered FcRn binding polypeptide
EVYAAKHEIRWLPNLTFDQRVAFIHKLDD

SEQ ID NO: 269 - protein, 29 aa, ARTIFICIAL SEQUENCE
  Engineered FcRn binding polypeptide
EISRAKHEIRWLPNLTFDQRVAFIHKLDD

SEQ ID NO: 270 - protein, 29 aa, ARTIFICIAL SEQUENCE
  Engineered FcRn binding polypeptide
EYVTAAHEIRWLPNLTFDQRVAFIHKLRD

SEQ ID NO: 271 - protein, 29 aa, ARTIFICIAL SEQUENCE
  Engineered FcRn binding polypeptide
EHIDAGHEIRWLPNLTFDQRVAFIHKLRD

SEQ ID NO: 272 - protein, 29 aa, ARTIFICIAL SEQUENCE
  Engineered FcRn binding polypeptide
EILQAKHEIRWLPNLTFDQRVAFIHKLND

SEQ ID NO: 273 - protein, 29 aa, ARTIFICIAL SEQUENCE
  Engineered FcRn binding polypeptide
ENSQAKHEIRWLPNLTFDQRVAFIHKLND

SEQ ID NO: 274 - protein, 29 aa, ARTIFICIAL SEQUENCE
  Engineered FcRn binding polypeptide
EYRVAAKEIRWLPNLTFDQRVAFIHKLRD

SEQ ID NO: 275 - protein, 29 aa, ARTIFICIAL SEQUENCE
  Engineered FcRn binding polypeptide
EIYNAGHEIRWLPNLTFDQRVAFIRKLRD

SEQ ID NO: 276 - protein, 29 aa, ARTIFICIAL SEQUENCE
  Engineered FcRn binding polypeptide
ESNEAAAEIRWLPNLTFDQRVAFIHKLRD

SEQ ID NO: 277 - protein, 29 aa, ARTIFICIAL SEQUENCE
  Engineered FcRn binding polypeptide
ESQLAAAEIRWLPNLTFDQRVAFIRKLRD

SEQ ID NO: 278 - protein, 29 aa, ARTIFICIAL SEQUENCE
  Engineered FcRn binding polypeptide
ELKEAGHEIRWLPNLTFDQRVAFIHKLQD

SEQ ID NO: 279 - protein, 29 aa, ARTIFICIAL SEQUENCE
  Engineered FcRn binding polypeptide
ETRVASVEIRWLPNLTFDQRVAFIQKLND

SEQ ID NO: 280 - protein, 29 aa, ARTIFICIAL SEQUENCE
  Engineered FcRn binding polypeptide
ELRTAAHEIRWLPNLTFDQRVAFIHKLND

SEQ ID NO: 281 - protein, 29 aa, ARTIFICIAL SEQUENCE
  Engineered FcRn binding polypeptide
EKTYAHFEIRWLPNLTFDQRVAFISKLWD

SEQ ID NO: 282 - protein, 29 aa, ARTIFICIAL SEQUENCE
  Engineered FcRn binding polypeptide
EEAQASHEIRWLPNLTFDQRVAFIHKLRD

SEQ ID NO: 283 - protein, 29 aa, ARTIFICIAL SEQUENCE
  Engineered FcRn binding polypeptide
EITSAAHEIRWLPNLTFDQRVAFIHKLRD

SEQ ID NO: 284 - protein, 29 aa, ARTIFICIAL SEQUENCE
  Engineered FcRn binding polypeptide
EVKTASHEIRWLPNLTFDQRVAFIHKLKD

SEQ ID NO: 285 - protein, 29 aa, ARTIFICIAL SEQUENCE
  Engineered FcRn binding polypeptide
ETKVAAHEIRWLPNLTFDQRVAFIHKLRD

SEQ ID NO: 286 - protein, 29 aa, ARTIFICIAL SEQUENCE
  Engineered FcRn binding polypeptide
EDLVAQHEIRWLPNLTFDQRVAFIRKLRD

SEQ ID NO: 287 - protein, 29 aa, ARTIFICIAL SEQUENCE
  Engineered FcRn binding polypeptide
ETQTAFNEIRWLPNLTYDQRAAFILKLWD

SEQ ID NO: 288 - protein, 29 aa, ARTIFICIAL SEQUENCE
  Engineered FcRn binding polypeptide
EIKDAGHEIRWLPNLTFDQRVAFIRKLRD

SEQ ID NO: 289 - protein, 29 aa, ARTIFICIAL SEQUENCE
  Engineered FcRn binding polypeptide
EYKEAGHEIRWLPNLTYDQRVAFIVKLRD

SEQ ID NO: 290 - protein, 29 aa, ARTIFICIAL SEQUENCE
  Engineered FcRn binding polypeptide
EAALAAHEIRWLPNLTFDQRVAFIHKLKD

SEQ ID NO: 291 - protein, 29 aa, ARTIFICIAL SEQUENCE
  Engineered FcRn binding polypeptide
EQERAAHEIRWLPNLTFDQRVAFIRKLRD

SEQ ID NO: 292 - protein, 29 aa, ARTIFICIAL SEQUENCE
  Engineered FcRn binding polypeptide
EWFDAAHEIRWLPNLTFDQRVAFIRKLRD

SEQ ID NO: 293 - protein, 29 aa, ARTIFICIAL SEQUENCE
  Engineered FcRn binding polypeptide
EIIQAKHEIRWLPNLTFDQRVAFIHKLDD

SEQ ID NO: 294 - protein, 29 aa, ARTIFICIAL SEQUENCE
  Engineered FcRn binding polypeptide
ELTNAKHEIRWLPNLTFDQRVAFIHKLDD

SEQ ID NO: 295 - protein, 29 aa, ARTIFICIAL SEQUENCE
  Engineered FcRn binding polypeptide
EIQLAKHEIRWLPNLTFDQRVAFIHKLDD

SEQ ID NO: 296 - protein, 29 aa, ARTIFICIAL SEQUENCE
  Engineered FcRn binding polypeptide
EIHDAKHEIRWLPNLTFDQRVAFIHKLQD

SEQ ID NO: 297 - protein, 29 aa, ARTIFICIAL SEQUENCE
  Engineered FcRn binding polypeptide
EVKIASHEIRWLPNLTFDQRVAFIHKLRD

SEQ ID NO: 298 - protein, 29 aa, ARTIFICIAL SEQUENCE
  Engineered FcRn binding polypeptide
EQHSAAHEIRWLPNLTFDQRVAFIRKLRD

SEQ ID NO: 299 - protein, 29 aa, ARTIFICIAL SEQUENCE
  Engineered FcRn binding polypeptide
EVFAASAEIRWLPNLTFDQRVAFIHKLRD

SEQ ID NO: 300 - protein, 29 aa, ARTIFICIAL SEQUENCE
  Engineered FcRn binding polypeptide
ETDLAGHEIRWLPNLTFDQRVAFIRKLRD

SEQ ID NO: 301 - protein, 29 aa, ARTIFICIAL SEQUENCE
  Engineered FcRn binding polypeptide
EANFAGHEIRWLPNLTFDQRVAFIRKLRD

SEQ ID NO: 302 - protein, 29 aa, ARTIFICIAL SEQUENCE
  Engineered FcRn binding polypeptide
EFETAGHEIRWLPNLTFDQRVAFITKLWD

SEQ ID NO: 303 - protein, 29 aa, ARTIFICIAL SEQUENCE
  Engineered FcRn binding polypeptide
EVNLAKHEIRWLPNLTFDQRVAFIHKLDD

SEQ ID NO: 304 - protein, 29 aa, ARTIFICIAL SEQUENCE
  Engineered FcRn binding polypeptide
EADTAAHEIRWLPNLTFDQRVAFIYKLRD

SEQ ID NO: 305 - protein, 29 aa, ARTIFICIAL SEQUENCE
  Engineered FcRn binding polypeptide
EFVDAGHEIRWLPNLTFDQRVAFIQKLRD

SEQ ID NO: 306 - protein, 29 aa, ARTIFICIAL SEQUENCE
  Engineered FcRn binding polypeptide
EDHKAEHEIRWLPNLTFDQRVAFIHKLRD

SEQ ID NO: 307 - protein, 29 aa, ARTIFICIAL SEQUENCE
  Engineered FcRn binding polypeptide
ETVDAGHEIRWLPNLTFDQRVAFIHKLAD

SEQ ID NO: 308 - protein, 29 aa, ARTIFICIAL SEQUENCE
  Engineered FcRn binding polypeptide
ESQRAGHEIRWLPNLTFDQRVAFITKLRD

SEQ ID NO: 309 - protein, 29 aa, ARTIFICIAL SEQUENCE
  Engineered FcRn binding polypeptide
EWSSAAHEIRWLPNLTFDQRVAFIHKLQD

SEQ ID NO: 310 - protein, 29 aa, ARTIFICIAL SEQUENCE
  Engineered FcRn binding polypeptide
EVAVAGHEIRWLPNLTYDQRVAFIVKLRD

SEQ ID NO: 311 - protein, 29 aa, ARTIFICIAL SEQUENCE
  Engineered FcRn binding polypeptide
ESAEAGHEIRWLPNLTFDQRVAFIEKLRD

SEQ ID NO: 312 - protein, 29 aa, ARTIFICIAL SEQUENCE
  Engineered FcRn binding polypeptide
EAVAAGHEIRWLPNLTFDQRVAFIHKLND

SEQ ID NO: 313 - protein, 29 aa, ARTIFICIAL SEQUENCE
  Engineered FcRn binding polypeptide
EFQIAGHEIRWLPNLTFDQRVAFINKLRD

SEQ ID NO: 314 - protein, 29 aa, ARTIFICIAL SEQUENCE
  Engineered FcRn binding polypeptide
ELMVAKHEIRWLPNLTFDQRVAFIHKLDD

SEQ ID NO: 315 - protein, 29 aa, ARTIFICIAL SEQUENCE
  Engineered FcRn binding polypeptide
EYDSAAHEIRWLPNLTYDQRVAFILKLRD

SEQ ID NO: 316 - protein, 29 aa, ARTIFICIAL SEQUENCE
  Engineered FcRn binding polypeptide
EVLEAKHEIRWLPNLTFDQRVAFIHKLDD

SEQ ID NO: 317 - protein, 29 aa, ARTIFICIAL SEQUENCE
  Engineered FcRn binding polypeptide
ESIAASHEIRWLPNLTFDQRVAFIHKLRD

SEQ ID NO: 318 - protein, 29 aa, ARTIFICIAL SEQUENCE
  Engineered FcRn binding polypeptide
EVAEAGHEIRWLPNLTFDQRVAFISKLRD

SEQ ID NO: 319 - protein, 29 aa, ARTIFICIAL SEQUENCE
  Engineered FcRn binding polypeptide
EQAKAAHEIRWLPNLTFDQRVAFIHKLND

SEQ ID NO: 320 - protein, 29 aa, ARTIFICIAL SEQUENCE
  Engineered FcRn binding polypeptide
ERDDAAHEIRWLPNLTFDQRVAFIEKLRD

SEQ ID NO: 321 - protein, 29 aa, ARTIFICIAL SEQUENCE
  Engineered FcRn binding polypeptide
EAKDASHEIRWLPNLTFDQRVAFIHKLRD

SEQ ID NO: 322 - protein, 29 aa, ARTIFICIAL SEQUENCE
  Engineered FcRn binding polypeptide
EASSAAHEIRWLPNLTFDQRVAFIQKLRD

SEQ ID NO: 323 - protein, 29 aa, ARTIFICIAL SEQUENCE
  Engineered FcRn binding polypeptide
EWMEASHEIRWLPNLTYDQRVAFIVKLRD

SEQ ID NO: 324 - protein, 29 aa, ARTIFICIAL SEQUENCE
  Engineered FcRn binding polypeptide
EQKNAAHEIRWLPNLTFDQRVAFIEKLRD

SEQ ID NO: 325 - protein, 29 aa, ARTIFICIAL SEQUENCE
  Engineered FcRn binding polypeptide
EIENAKHEIRWLPNLTFDQRVAFIHKLDD

SEQ ID NO: 326 - protein, 29 aa, ARTIFICIAL SEQUENCE
  Engineered FcRn binding polypeptide
EVNRASHEIRWLPNLTFDQRVAFIHKLLD

SEQ ID NO: 327 - protein, 29 aa, ARTIFICIAL SEQUENCE
  Engineered FcRn binding polypeptide
ERLLAGHEIRWLPNLTFDQRVAFINKLRD

SEQ ID NO: 328 - protein, 29 aa, ARTIFICIAL SEQUENCE
  Engineered FcRn binding polypeptide
EVSIAGHEIRWLPNLTFDQRVAFIRKLRD

SEQ ID NO: 329 - protein, 29 aa, ARTIFICIAL SEQUENCE
  Engineered FcRn binding polypeptide
EKEVAAHEIRWLPNLTFDQRVAFIHKLDD

SEQ ID NO: 330 - protein, 29 aa, ARTIFICIAL SEQUENCE
  Engineered FcRn binding polypeptide
ESERASHEIRWLPNLTFDQRVAFIHKLRD

SEQ ID NO: 331 - protein, 29 aa, ARTIFICIAL SEQUENCE
  Engineered FcRn binding polypeptide
EWNEAAHEIRWLPNLTFDQRVAFIHKLRD

SEQ ID NO: 332 - protein, 29 aa, ARTIFICIAL SEQUENCE
  Engineered FcRn binding polypeptide
ENVDAAHEIRWLPNLTFDQRVAFIHKLRD

SEQ ID NO: 333 - protein, 29 aa, ARTIFICIAL SEQUENCE
  Engineered FcRn binding polypeptide
EADAASHEIRWLPNLTFDQRVAFIRKLRD

SEQ ID NO: 334 - protein, 29 aa, ARTIFICIAL SEQUENCE
  Engineered FcRn binding polypeptide
ELESASHEIRWLPNLTFDQRVAFIHKLID

SEQ ID NO: 335 - protein, 29 aa, ARTIFICIAL SEQUENCE
  Engineered FcRn binding polypeptide
EEQLAAHEIRWLPNLTFDQRVAFIRKLRD

SEQ ID NO: 336 - protein, 29 aa, ARTIFICIAL SEQUENCE
  Engineered FcRn binding polypeptide
EFELAGHEIRWLPNLTFDQRVAFIHKLDD

SEQ ID NO: 337 - protein, 29 aa, ARTIFICIAL SEQUENCE
  Engineered FcRn binding polypeptide
EAFVAQHEIRWLPNLTYDQRVAFIVKLRD

SEQ ID NO: 338 - protein, 29 aa, ARTIFICIAL SEQUENCE
  Engineered FcRn binding polypeptide
EALKASHEIRWLPNLTFDQRVAFINKLRD

SEQ ID NO: 339 - protein, 29 aa, ARTIFICIAL SEQUENCE
  Engineered FcRn binding polypeptide
ELERAGHEIRWLPNLTFDQRVAFIKKLTD

SEQ ID NO: 340 - protein, 29 aa, ARTIFICIAL SEQUENCE
  Engineered FcRn binding polypeptide
EVEWAKHEIRWLPNLTFDQRVAFIHKLQD

SEQ ID NO: 341 - protein, 29 aa, ARTIFICIAL SEQUENCE
  Engineered FcRn binding polypeptide
EKASAQHEIRWLPNLTFDQRVAFIHKLDD

SEQ ID NO: 342 - protein, 29 aa, ARTIFICIAL SEQUENCE
  Engineered FcRn binding polypeptide
ETEIAKHEIRWLPNLTFDQRVAFIHKLDD

SEQ ID NO: 343 - protein, 29 aa, ARTIFICIAL SEQUENCE
  Engineered FcRn binding polypeptide
EVNLAAHEIRWLPNLTFDQRVAFIHKLTD

SEQ ID NO: 344 - protein, 29 aa, ARTIFICIAL SEQUENCE
  Engineered FcRn binding polypeptide
EAEEAAHEIRWLPNLTFDQRVAFIHKLRD

SEQ ID NO: 345 - protein, 29 aa, ARTIFICIAL SEQUENCE
  Engineered FcRn binding polypeptide
ETDRAKHEIRWLPNLTFDQRVAFIHKLND

SEQ ID NO: 346 - protein, 29 aa, ARTIFICIAL SEQUENCE
  Engineered FcRn binding polypeptide
EFAQAGHEIRWLPNLTFDQRVAFIHKLKD

SEQ ID NO: 347 - protein, 29 aa, ARTIFICIAL SEQUENCE
  Engineered FcRn binding polypeptide
ETDEASHEIRWLPNLTFDQRVAFIRKLRD

SEQ ID NO: 348 - protein, 29 aa, ARTIFICIAL SEQUENCE
  Engineered FcRn binding polypeptide
ENADAGHEIRWLPNLTFDQRVAFIQKLRD

SEQ ID NO: 349 - protein, 29 aa, ARTIFICIAL SEQUENCE
  Engineered FcRn binding polypeptide
ESTQAAHEIRWLPNLTFDQRVAFIHKLQD

SEQ ID NO: 350 - protein, 29 aa, ARTIFICIAL SEQUENCE
  Engineered FcRn binding polypeptide
EQALAAHEIRWLPNLTFDQRVAFIHKLND

SEQ ID NO: 351 - protein, 29 aa, ARTIFICIAL SEQUENCE
  Engineered FcRn binding polypeptide
EAHAASHEIRWLPNLTFDQRVAFIHKLDD

SEQ ID NO: 352 - protein, 29 aa, ARTIFICIAL SEQUENCE
  Engineered FcRn binding polypeptide
EVDNAGHEIRWLPNLTFDQRVAFIQKLRD

SEQ ID NO: 353 - protein, 29 aa, ARTIFICIAL SEQUENCE
  Engineered FcRn binding polypeptide
EAGRAAHEIRWLPNLTWDQRVAFIWKLRD

SEQ ID NO: 354 - protein, 49 aa, ARTIFICIAL SEQUENCE
  Engineered FcRn binding polypeptide
KEQDAAAHEIRWLPNLTFDQRVAFIHKLADDPSQSSELLSEAKKLNDSQ

SEQ ID NO: 355 - protein, 49 aa, ARTIFICIAL SEQUENCE
  Engineered FcRn binding polypeptide
KEWMRAAHEIRWLPNLTFDQRVAFIHKLEDDPSQSSELLSEAKKLNDSQ

SEQ ID NO: 356 - protein, 49 aa, ARTIFICIAL SEQUENCE
  Engineered FcRn binding polypeptide
KEANTAAHEIRWLPNLTFDQRVAFIRKLWDDPSQSSELLSEAKKLNDSQ

SEQ ID NO: 357 - protein, 49 aa, ARTIFICIAL SEQUENCE
  Engineered FcRn binding polypeptide
KEFESAAHEIRWLPNLTYDQRVAFIHKLSDDPSQSSELLSEAKKLNDSQ

SEQ ID NO: 358 - protein, 49 aa, ARTIFICIAL SEQUENCE
  Engineered FcRn binding polypeptide
KERSAAAHEIRWLPNLTFDQRVAFILKLTDDPSQSSELLSEAKKLNDSQ

SEQ ID NO: 359 - protein, 49 aa, ARTIFICIAL SEQUENCE
  Engineered FcRn binding polypeptide
KESDSAVHEIRWLPNLTFDQRVAFIHKLLDDPSQSSELLSEAKKLNDSQ

SEQ ID NO: 360 - protein, 49 aa, ARTIFICIAL SEQUENCE
  Engineered FcRn binding polypeptide
KEADNAGHEIRWLPNLTWAQRWAFIHKLLDDPSQSSELLSEAKKLNDSQ

SEQ ID NO: 361 - protein, 49 aa, ARTIFICIAL SEQUENCE
  Engineered FcRn binding polypeptide
KEDDTAAHEIRWLPNLTYEQRWAFIHKLYDDPSQSSELLSEAKKLNDSQ

SEQ ID NO: 362 - protein, 49 aa, ARTIFICIAL SEQUENCE
  Engineered FcRn binding polypeptide
KEQHDAAHEIRWLPNLTYDQRVAFIRKLHDDPSQSSELLSEAKKLNDSQ

SEQ ID NO: 363 - protein, 49 aa, ARTIFICIAL SEQUENCE
  Engineered FcRn binding polypeptide
KENQGAAHEIRWLPNLTWDQRVAFIRKLQDDPSQSSELLSEAKKLNDSQ

SEQ ID NO: 364 - protein, 49 aa, ARTIFICIAL SEQUENCE
  Engineered FcRn binding polypeptide
KERTQASHEIRWLPNLTYDQRVAFINKLRDDPSQSSELLSEAKKLNDSQ

SEQ ID NO: 365 - protein, 49 aa, ARTIFICIAL SEQUENCE
  Engineered FcRn binding polypeptide
KERKDAGHEIRWLPNLTFDQRSAFIKKLEDDPSQSSELLSEAKKLNDSQ

SEQ ID NO: 366 - protein, 49 aa, ARTIFICIAL SEQUENCE
  Engineered FcRn binding polypeptide
KERQEAAHEIRWLPNLTFDQRVAFIVKLLDDPSQSSELLSEAKKLNDSQ

SEQ ID NO: 367 - protein, 49 aa, ARTIFICIAL SEQUENCE
  Engineered FcRn binding polypeptide
KEEDVAAHEIRWLPNLTFNQRAAFIDKLLDDPSQSSELLSEAKKLNDSQ

SEQ ID NO: 368 - protein, 49 aa, ARTIFICIAL SEQUENCE
  Engineered FcRn binding polypeptide
KENQDAAHEIRWLPNLTYDQRVAFIGKLNDDPSQSSELLSEAKKLNDSQ

SEQ ID NO: 369 - protein, 49 aa, ARTIFICIAL SEQUENCE
  Engineered FcRn binding polypeptide
KESGYAVHEIRWLPNLTFDQRVAFINKLQDDPSQSSELLSEAKKLNDSQ

SEQ ID NO: 370 - protein, 49 aa, ARTIFICIAL SEQUENCE
  Engineered FcRn binding polypeptide
KESKDAAHEIRWLPNLTFDQRVAFIHKLRDDPSQSSELLSEAKKLNDSQ

SEQ ID NO: 371 - protein, 49 aa, ARTIFICIAL SEQUENCE
  Engineered FcRn binding polypeptide
KEKKEAAHEIRWLPNLTFDQRVAFIHKLRDDPSQSSELLSEAKKLNDSQ

SEQ ID NO: 372 - protein, 49 aa, ARTIFICIAL SEQUENCE
  Engineered FcRn binding polypeptide
KEWHQAAHEIRWLPNLTFDQRVAFIHKLRDDPSQSSELLSEAKKLNDSQ

SEQ ID NO: 373 - protein, 49 aa, ARTIFICIAL SEQUENCE
  Engineered FcRn binding polypeptide
KEWTDAAHEIRWLPNLTFDQRVAFIHKLRDDPSQSSELLSEAKKLNDSQ

SEQ ID NO: 374 - protein, 49 aa, ARTIFICIAL SEQUENCE
  Engineered FcRn binding polypeptide
KEISAASHEIRWLPNLTFDQRVAFIHKLRDDPSQSSELLSEAKKLNDSQ

SEQ ID NO: 375 - protein, 49 aa, ARTIFICIAL SEQUENCE
  Engineered FcRn binding polypeptide
KEQQAAAHEIRWLPNLTFDQRVAFIHKLRDDPSQSSELLSEAKKLNDSQ

SEQ ID NO: 376 - protein, 49 aa, ARTIFICIAL SEQUENCE
  Engineered FcRn binding polypeptide
KELEKAGHEIRWLPNLTFDQRVAFIHKLRDDPSQSSELLSEAKKLNDSQ

SEQ ID NO: 377 - protein, 49 aa, ARTIFICIAL SEQUENCE
  Engineered FcRn binding polypeptide
KEYLDAAHEIRWLPNLTFDQRVAFIHKLRDDPSQSSELLSEAKKLNDSQ

SEQ ID NO: 378 - protein, 49 aa, ARTIFICIAL SEQUENCE
  Engineered FcRn binding polypeptide
KELKDAGHEIRWLPNLTFDQRVAFIHKLRDDPSQSSELLSEAKKLNDSQ

SEQ ID NO: 379 - protein, 49 aa, ARTIFICIAL SEQUENCE
  Engineered FcRn binding polypeptide
KEHVDAAHEIRWLPNLTFDQRVAFIHKLRDDPSQSSELLSEAKKLNDSQ

SEQ ID NO: 380 - protein, 49 aa, ARTIFICIAL SEQUENCE
  Engineered FcRn binding polypeptide
KEYAAAAHEIRWLPNLTFDQRVAFIHKLRDDPSQSSELLSEAKKLNDSQ

SEQ ID NO: 381 - protein, 49 aa, ARTIFICIAL SEQUENCE
  Engineered FcRn binding polypeptide
KEVDIAAHEIRWLPNLTFDQRVAFIHKLRDDPSQSSELLSEAKKLNDSQ

SEQ ID NO: 382 - protein, 49 aa, ARTIFICIAL SEQUENCE
  Engineered FcRn binding polypeptide
KEIDEAKHEIRWLPNLTFDQRVAFIHKLDDDPSQSSELLSEAKKLNDSQ

SEQ ID NO: 383 - protein, 49 aa, ARTIFICIAL SEQUENCE
  Engineered FcRn binding polypeptide
KELRQAGHEIRWLPNLTFDQRVAFIHKLRDDPSQSSELLSEAKKLNDSQ

SEQ ID NO: 384 - protein, 49 aa, ARTIFICIAL SEQUENCE
  Engineered FcRn binding polypeptide
KELQSAAHEIRWLPNLTFDQRVAFIHKLKDDPSQSSELLSEAKKLNDSQ

SEQ ID NO: 385 - protein, 49 aa, ARTIFICIAL SEQUENCE
  Engineered FcRn binding polypeptide
KELEKAAHEIRWLPNLTFDQRVAFIHKLRDDPSQSSELLSEAKKLNDSQ

SEQ ID NO: 386 - protein, 49 aa, ARTIFICIAL SEQUENCE
  Engineered FcRn binding polypeptide
KEAHEAAHEIRWLPNLTFDQRVAFIHKLRDDPSQSSELLSEAKKLNDSQ

SEQ ID NO: 387 - protein, 49 aa, ARTIFICIAL SEQUENCE
  Engineered FcRn binding polypeptide
KELQAASHEIRWLPNLTFDQRVAFIHKLRDDPSQSSELLSEAKKLNDSQ

SEQ ID NO: 388 - protein, 49 aa, ARTIFICIAL SEQUENCE
  Engineered FcRn binding polypeptide
KEIESAKHEIRWLPNLTFDQRVAFIHKLNDDPSQSSELLSEAKKLNDSQ

SEQ ID NO: 389 - protein, 49 aa, ARTIFICIAL SEQUENCE
  Engineered FcRn binding polypeptide
KEWKVAAHEIRWLPNLTFDQRVAFIHKLRDDPSQSSELLSEAKKLNDSQ

SEQ ID NO: 390 - protein, 49 aa, ARTIFICIAL SEQUENCE
  Engineered FcRn binding polypeptide
KEWKAAAHEIRWLPNLTFDQRVAFIHKLRDDPSQSSELLSEAKKLNDSQ

SEQ ID NO: 391 - protein, 49 aa, ARTIFICIAL SEQUENCE
  Engineered FcRn binding polypeptide
KEIDLAKHEIRWLPNLTFDQRVAFIHKLDDDPSQSSELLSEAKKLNDSQ

SEQ ID NO: 392 - protein, 49 aa, ARTIFICIAL SEQUENCE
  Engineered FcRn binding polypeptide
KELEAARHEIRWLPNLTFDQRVAFIHKLNDDPSQSSELLSEAKKLNDSQ

SEQ ID NO: 393 - protein, 49 aa, ARTIFICIAL SEQUENCE
  Engineered FcRn binding polypeptide
KEAATAGHEIRWLPNLTFDQRVAFIHKLRDDPSQSSELLSEAKKLNDSQ

SEQ ID NO: 394 - protein, 49 aa, ARTIFICIAL SEQUENCE
  Engineered FcRn binding polypeptide
KEWQQAAHEIRWLPNLTFDQRVAFIHKLRDDPSQSSELLSEAKKLNDSQ

SEQ ID NO: 395 - protein, 49 aa, ARTIFICIAL SEQUENCE
  Engineered FcRn binding polypeptide
KEADQAGHEIRWLPNLTFDQRVAFIRKLRDDPSQSSELLSEAKKLNDSQ

SEQ ID NO: 396 - protein, 49 aa, ARTIFICIAL SEQUENCE
  Engineered FcRn binding polypeptide
KEQSKAAHEIRWLPNLTFDQRVAFIHKLRDDPSQSSELLSEAKKLNDSQ

SEQ ID NO: 397 - protein, 49 aa, ARTIFICIAL SEQUENCE
  Engineered FcRn binding polypeptide
KEADAAGHEIRWLPNLTFDQRVAFIHKLRDDPSQSSELLSEAKKLNDSQ

SEQ ID NO: 398 - protein, 49 aa, ARTIFICIAL SEQUENCE
  Engineered FcRn binding polypeptide
KEFMDAGHEIRWLPNLTFDQRVAFIHKLRDDPSQSSELLSEAKKLNDSQ

SEQ ID NO: 399 - protein, 49 aa, ARTIFICIAL SEQUENCE
  Engineered FcRn binding polypeptide
KESKQAAHEIRWLPNLTFDQRVAFIHKLRDDPSQSSELLSEAKKLNDSQ

SEQ ID NO: 400 - protein, 49 aa, ARTIFICIAL SEQUENCE
  Engineered FcRn binding polypeptide
KEVSDAAHEIRWLPNLTFDQRVAFIHKLRDDPSQSSELLSEAKKLNDSQ

SEQ ID NO: 401 - protein, 49 aa, ARTIFICIAL SEQUENCE
  Engineered FcRn binding polypeptide
KEADSASHEIRWLPNLTFDQRVAFIHKLRDDPSQSSELLSEAKKLNDSQ

SEQ ID NO: 402 - protein, 49 aa, ARTIFICIAL SEQUENCE
  Engineered FcRn binding polypeptide
KELMEAAHEIRWLPNLTFDQRVAFIHKLRDDPSQSSELLSEAKKLNDSQ

SEQ ID NO: 403 - protein, 49 aa, ARTIFICIAL SEQUENCE
  Engineered FcRn binding polypeptide
KELNTAAHEIRWLPNLTFDQRVAFIHKLKDDPSQSSELLSEAKKLNDSQ

SEQ ID NO: 404 - protein, 49 aa, ARTIFICIAL SEQUENCE
  Engineered FcRn binding polypeptide
KEVHEAGHEIRWLPNLTFDQRVAFIHKLRDDPSQSSELLSEAKKLNDSQ

SEQ ID NO: 405 - protein, 49 aa, ARTIFICIAL SEQUENCE
  Engineered FcRn binding polypeptide
KESTAAAHEIRWLPNLTFDQRVAFIHKLRDDPSQSSELLSEAKKLNDSQ

SEQ ID NO: 406 - protein, 49 aa, ARTIFICIAL SEQUENCE
  Engineered FcRn binding polypeptide
KEWYNAAHEIRWLPNLTFDQRVAFIHKLRDDPSQSSELLSEAKKLNDSQ

SEQ ID NO: 407 - protein, 49 aa, ARTIFICIAL SEQUENCE
  Engineered FcRn binding polypeptide
KEWNDAAHEIRWLPNLTFDQRVAFIHKLRDDPSQSSELLSEAKKLNDSQ

SEQ ID NO: 408 - protein, 49 aa, ARTIFICIAL SEQUENCE
  Engineered FcRn binding polypeptide
KEVEVAKHEIRWLPNLTFDQRVAFIHKLDDDPSQSSELLSEAKKLNDSQ

SEQ ID NO: 409 - protein, 49 aa, ARTIFICIAL SEQUENCE
  Engineered FcRn binding polypeptide
KEFNFAAHEIRWLPNLTFDQRVAFIHKLRDDPSQSSELLSEAKKLNDSQ

SEQ ID NO: 410 - protein, 49 aa, ARTIFICIAL SEQUENCE
  Engineered FcRn binding polypeptide
KEHDSAAHEIRWLPNLTFDQRVAFIHKLRDDPSQSSELLSEAKKLNDSQ

SEQ ID NO: 411 - protein, 49 aa, ARTIFICIAL SEQUENCE
  Engineered FcRn binding polypeptide
KEWMDAAHEIRWLPNLTFDQRVAFIHKLRDDPSQSSELLSEAKKLNDSQ

SEQ ID NO: 412 - protein, 49 aa, ARTIFICIAL SEQUENCE
  Engineered FcRn binding polypeptide
KEFSAAGHEIRWLPNLTFDQRVAFIHKLRDDPSQSSELLSEAKKLNDSQ

SEQ ID NO: 413 - protein, 49 aa, ARTIFICIAL SEQUENCE
  Engineered FcRn binding polypeptide
KELNSAAHEIRWLPNLTFDQRVAFIHKLRDDPSQSSELLSEAKKLNDSQ

SEQ ID NO: 414 - protein, 49 aa, ARTIFICIAL SEQUENCE
  Engineered FcRn binding polypeptide
KEVDTAAHEIRWLPNLTFDQRVAFIHKLRDDPSQSSELLSEAKKLNDSQ

SEQ ID NO: 415 - protein, 49 aa, ARTIFICIAL SEQUENCE
  Engineered FcRn binding polypeptide
KESQIAGHEIRWLPNLTFDQRVAFIHKLRDDPSQSSELLSEAKKLNDSQ

SEQ ID NO: 416 - protein, 49 aa, ARTIFICIAL SEQUENCE
  Engineered FcRn binding polypeptide
KEVSAASHEIRWLPNLTFDQRVAFIHKLRDDPSQSSELLSEAKKLNDSQ

SEQ ID NO: 417 - protein, 49 aa, ARTIFICIAL SEQUENCE
  Engineered FcRn binding polypeptide
KEDQDAAHEIRWLPNLTFDQRVAFIHKLRDDPSQSSELLSEAKKLNDSQ

SEQ ID NO: 418 - protein, 49 aa, ARTIFICIAL SEQUENCE
  Engineered FcRn binding polypeptide
KELEAAKHEIRWLPNLTFDQRVAFIHKLDDDPSQSSELLSEAKKLNDSQ

SEQ ID NO: 419 - protein, 49 aa, ARTIFICIAL SEQUENCE
  Engineered FcRn binding polypeptide
KESKRAAHEIRWLPNLTFDQRVAFIHKLRDDPSQSSELLSEAKKLNDSQ

SEQ ID NO: 420 - protein, 49 aa, ARTIFICIAL SEQUENCE
  Engineered FcRn binding polypeptide
KEYVKAGHEIRWLPNLTFDQRVAFIRKLRDDPSQSSELLSEAKKLNDSQ

SEQ ID NO: 421 - protein, 49 aa, ARTIFICIAL SEQUENCE
  Engineered FcRn binding polypeptide
KEFSRAGHEIRWLPNLTFDQRVAFIHKLRDDPSQSSELLSEAKKLNDSQ

SEQ ID NO: 422 - protein, 49 aa, ARTIFICIAL SEQUENCE
  Engineered FcRn binding polypeptide
KEWQFAAHEIRWLPNLTFDQRVAFIHKLRDDPSQSSELLSEAKKLNDSQ

SEQ ID NO: 423 - protein, 49 aa, ARTIFICIAL SEQUENCE
  Engineered FcRn binding polypeptide
KEWQIAAHEIRWLPNLTFDQRVAFIHKLRDDPSQSSELLSEAKKLNDSQ

SEQ ID NO: 424 - protein, 49 aa, ARTIFICIAL SEQUENCE
  Engineered FcRn binding polypeptide
KELQEAAHEIRWLPNLTFDQRVAFIHKLRDDPSQSSELLSEAKKLNDSQ

SEQ ID NO: 425 - protein, 49 aa, ARTIFICIAL SEQUENCE
  Engineered FcRn binding polypeptide
KEYRAAAHEIRWLPNLTFDQRVAFIHKLRDDPSQSSELLSEAKKLNDSQ

SEQ ID NO: 426 - protein, 49 aa, ARTIFICIAL SEQUENCE
  Engineered FcRn binding polypeptide
KELASAGHEIRWLPNLTFDQRVAFIHKLRDDPSQSSELLSEAKKLNDSQ

SEQ ID NO: 427 - protein, 49 aa, ARTIFICIAL SEQUENCE
  Engineered FcRn binding polypeptide
KEVQSASHEIRWLPNLTFDQRVAFIHKLRDDPSQSSELLSEAKKLNDSQ

SEQ ID NO: 428 - protein, 49 aa, ARTIFICIAL SEQUENCE
  Engineered FcRn binding polypeptide
KEIEDAGHEIRWLPNLTFDQRVAFIHKLRDDPSQSSELLSEAKKLNDSQ

SEQ ID NO: 429 - protein, 49 aa, ARTIFICIAL SEQUENCE
  Engineered FcRn binding polypeptide
KENQAAAHEIRWLPNLTFDQRVAFIHKLRDDPSQSSELLSEAKKLNDSQ

SEQ ID NO: 430 - protein, 49 aa, ARTIFICIAL SEQUENCE
  Engineered FcRn binding polypeptide
KEATSAGHEIRWLPNLTFDQRVAFIVKLRDDPSQSSELLSEAKKLNDSQ

SEQ ID NO: 431 - protein, 49 aa, ARTIFICIAL SEQUENCE
  Engineered FcRn binding polypeptide
KEDEQAAHEIRWLPNLTFDQRVAFIHKLRDDPSQSSELLSEAKKLNDSQ

SEQ ID NO: 432 - protein, 49 aa, ARTIFICIAL SEQUENCE
  Engineered FcRn binding polypeptide
KEQNQAGHEIRWLPNLTFDQRVAFIHKLRDDPSQSSELLSEAKKLNDSQ

SEQ ID NO: 433 - protein, 49 aa, ARTIFICIAL SEQUENCE
  Engineered FcRn binding polypeptide
KEYTSAAHEIRWLPNLTFDQRVAFIHKLRDDPSQSSELLSEAKKLNDSQ

SEQ ID NO: 434 - protein, 49 aa, ARTIFICIAL SEQUENCE
  Engineered FcRn binding polypeptide
KEWDAAAHEIRWLPNLTFDQRVAFIHKLRDDPSQSSELLSEAKKLNDSQ

SEQ ID NO: 435 - protein, 49 aa, ARTIFICIAL SEQUENCE
  Engineered FcRn binding polypeptide
KEEMQAGHEIRWLPNLTFDQRVAFIHKLRDDPSQSSELLSEAKKLNDSQ

SEQ ID NO: 436 - protein, 49 aa, ARTIFICIAL SEQUENCE
  Engineered FcRn binding polypeptide
KELSDAAHEIRWLPNLTFDQRVAFIHKLNDDPSQSSELLSEAKKLNDSQ

SEQ ID NO: 437 - protein, 49 aa, ARTIFICIAL SEQUENCE
  Engineered FcRn binding polypeptide
KEIDAAKHEIRWLPNLTFDQRVAFIHKLDDDPSQSSELLSEAKKLNDSQ

SEQ ID NO: 438 - protein, 49 aa, ARTIFICIAL SEQUENCE
  Engineered FcRn binding polypeptide
KEAERAGHEIRWLPNLTFDQRVAFIRKLRDDPSQSSELLSEAKKLNDSQ

SEQ ID NO: 439 - protein, 49 aa, ARTIFICIAL SEQUENCE
  Engineered FcRn binding polypeptide
KEEDSAAHEIRWLPNLTFDQRVAFIHKLKDDPSQSSELLSEAKKLNDSQ

SEQ ID NO: 440 - protein, 49 aa, ARTIFICIAL SEQUENCE
  Engineered FcRn binding polypeptide
KEQKAAGHEIRWLPNLTFDQRVAFIHKLRDDPSQSSELLSEAKKLNDSQ

SEQ ID NO: 441 - protein, 49 aa, ARTIFICIAL SEQUENCE
  Engineered FcRn binding polypeptide
KEWDQAAHEIRWLPNLTFDQRVAFIHKLRDDPSQSSELLSEAKKLNDSQ

SEQ ID NO: 442 - protein, 49 aa, ARTIFICIAL SEQUENCE
  Engineered FcRn binding polypeptide
KEAKAAAHEIRWLPNLTFDQRVAFIHKLRDDPSQSSELLSEAKKLNDSQ

SEQ ID NO: 443 - protein, 49 aa, ARTIFICIAL SEQUENCE
  Engineered FcRn binding polypeptide
KELSEAAHEIRWLPNLTFDQRVAFIHKLKDDPSQSSELLSEAKKLNDSQ

SEQ ID NO: 444 - protein, 49 aa, ARTIFICIAL SEQUENCE
  Engineered FcRn binding polypeptide
KETEAAKHEIRWLPNLTFDQRVAFIHKLDDDPSQSSELLSEAKKLNDSQ

SEQ ID NO: 445 - protein, 49 aa, ARTIFICIAL SEQUENCE
  Engineered FcRn binding polypeptide
KEAKSAAHEIRWLPNLTFDQRVAFIHKLRDDPSQSSELLSEAKKLNDSQ

SEQ ID NO: 446 - protein, 49 aa, ARTIFICIAL SEQUENCE
  Engineered FcRn binding polypeptide
KEQSAAAHEIRWLPNLTFDQRVAFIHKLNDDPSQSSELLSEAKKLNDSQ

SEQ ID NO: 447 - protein, 49 aa, ARTIFICIAL SEQUENCE
  Engineered FcRn binding polypeptide
KEKERAAHEIRWLPNLTFDQRVAFIHKLRDDPSQSSELLSEAKKLNDSQ

SEQ ID NO: 448 - protein, 49 aa, ARTIFICIAL SEQUENCE
  Engineered FcRn binding polypeptide
KEWDEAAHEIRWLPNLTFDQRVAFIHKLKDDPSQSSELLSEAKKLNDSQ

SEQ ID NO: 449 - protein, 49 aa, ARTIFICIAL SEQUENCE
  Engineered FcRn binding polypeptide
KEEKDAAHEIRWLPNLTFDQRVAFIHKLRDDPSQSSELLSEAKKLNDSQ

SEQ ID NO: 450 - protein, 49 aa, ARTIFICIAL SEQUENCE
  Engineered FcRn binding polypeptide
KEIENAAHEIRWLPNLTFDQRVAFIWKLRDDPSQSSELLSEAKKLNDSQ

SEQ ID NO: 451 - protein, 49 aa, ARTIFICIAL SEQUENCE
  Engineered FcRn binding polypeptide
KETKEAAHEIRWLPNLTFDQRVAFIHKLWDDPSQSSELLSEAKKLNDSQ

SEQ ID NO: 452 - protein, 49 aa, ARTIFICIAL SEQUENCE
  Engineered FcRn binding polypeptide
KELEAAKHEIRWLPNLTFDQRVAFIHKLNDDPSQSSELLSEAKKLNDSQ

SEQ ID NO: 453 - protein, 49 aa, ARTIFICIAL SEQUENCE
  Engineered FcRn binding polypeptide
KEWAEAAHEIRWLPNLTFDQRVAFIHKLRDDPSQSSELLSEAKKLNDSQ

SEQ ID NO: 454 - protein, 49 aa, ARTIFICIAL SEQUENCE
  Engineered FcRn binding polypeptide
KESQEAGHEIRWLPNLTFDQRVAFIHKLRDDPSQSSELLSEAKKLNDSQ

SEQ ID NO: 455 - protein, 49 aa, ARTIFICIAL SEQUENCE
  Engineered FcRn binding polypeptide
KELSTAAHEIRWLPNLTFDQRVAFIHKLRDDPSQSSELLSEAKKLNDSQ

SEQ ID NO: 456 - protein, 49 aa, ARTIFICIAL SEQUENCE
  Engineered FcRn binding polypeptide
KEIEEAGHEIRWLPNLTFDQRVAFIHKLRDDPSQSSELLSEAKKLNDSQ

SEQ ID NO: 457 - protein, 49 aa, ARTIFICIAL SEQUENCE
  Engineered FcRn binding polypeptide
KELQTASHEIRWLPNLTFDQRVAFIHKLRDDPSQSSELLSEAKKLNDSQ

SEQ ID NO: 458 - protein, 49 aa, ARTIFICIAL SEQUENCE
  Engineered FcRn binding polypeptide
KEQDSAAHEIRWLPNLTFDQRVAFIRKLRDDPSQSSELLSEAKKLNDSQ

SEQ ID NO: 459 - protein, 49 aa, ARTIFICIAL SEQUENCE
  Engineered FcRn binding polypeptide
KESASAGHEIRWLPNLTFDQRVAFIHKLRDDPSQSSELLSEAKKLNDSQ

SEQ ID NO: 460 - protein, 49 aa, ARTIFICIAL SEQUENCE
  Engineered FcRn binding polypeptide
KEVAKASHEIRWLPNLTFDQRVAFIHKLRDDPSQSSELLSEAKKLNDSQ

SEQ ID NO: 461 - protein, 49 aa, ARTIFICIAL SEQUENCE
  Engineered FcRn binding polypeptide
KEVQEAAHEIRWLPNLTFDQRVAFIHKLWDDPSQSSELLSEAKKLNDSQ

SEQ ID NO: 462 - protein, 49 aa, ARTIFICIAL SEQUENCE
  Engineered FcRn binding polypeptide
KESYEAAHEIRWLPNLTFDQRVAFIHKLRDDPSQSSELLSEAKKLNDSQ

SEQ ID NO: 463 - protein, 49 aa, ARTIFICIAL SEQUENCE
  Engineered FcRn binding polypeptide
KETAEAGHEIRWLPNLTFDQRVAFIHKLRDDPSQSSELLSEAKKLNDSQ

SEQ ID NO: 464 - protein, 49 aa, ARTIFICIAL SEQUENCE
  Engineered FcRn binding polypeptide
KELEEAAHEIRWLPNLTFDQRVAFIHKLRDDPSQSSELLSEAKKLNDSQ

SEQ ID NO: 465 - protein, 49 aa, ARTIFICIAL SEQUENCE
  Engineered FcRn binding polypeptide
KEAAAAGHEIRWLPNLTFDQRVAFIHKLRDDPSQSSELLSEAKKLNDSQ

SEQ ID NO: 466 - protein, 49 aa, ARTIFICIAL SEQUENCE
  Engineered FcRn binding polypeptide
KEYVDAGHEIRWLPNLTFDQRVAFIRKLRDDPSQSSELLSEAKKLNDSQ

SEQ ID NO: 467 - protein, 49 aa, ARTIFICIAL SEQUENCE
  Engineered FcRn binding polypeptide
KEIQEAGHEIRWLPNLTFDQRVAFIHKLRDDPSQSSELLSEAKKLNDSQ

SEQ ID NO: 468 - protein, 49 aa, ARTIFICIAL SEQUENCE
  Engineered FcRn binding polypeptide
KESATAAHEIRWLPNLTFDQRVAFIHKLRDDPSQSSELLSEAKKLNDSQ

SEQ ID NO: 469 - protein, 49 aa, ARTIFICIAL SEQUENCE
  Engineered FcRn binding polypeptide
KEWMSAAHEIRWLPNLTFDQRVAFIHKLRDDPSQSSELLSEAKKLNDSQ

SEQ ID NO: 470 - protein, 49 aa, ARTIFICIAL SEQUENCE
  Engineered FcRn binding polypeptide
KEREQASHEIRWLPNLTFDQRVAFIHKLRDDPSQSSELLSEAKKLNDSQ

SEQ ID NO: 471 - protein, 49 aa, ARTIFICIAL SEQUENCE
  Engineered FcRn binding polypeptide
KEIEQAGHEIRWLPNLTFDQRVAFIHKLRDDPSQSSELLSEAKKLNDSQ

SEQ ID NO: 472 - protein, 49 aa, ARTIFICIAL SEQUENCE
  Engineered FcRn binding polypeptide
KEHNAAAHEIRWLPNLTFDQRVAFIHKLRDDPSQSSELLSEAKKLNDSQ

SEQ ID NO: 473 - protein, 49 aa, ARTIFICIAL SEQUENCE
  Engineered FcRn binding polypeptide
KEIEVAAHEIRWLPNLTFDQRVAFIHKLRDDPSQSSELLSEAKKLNDSQ

SEQ ID NO: 474 - protein, 49 aa, ARTIFICIAL SEQUENCE
  Engineered FcRn binding polypeptide
KERAEAAHEIRWLPNLTFDQRVAFIHKLRDDPSQSSELLSEAKKLNDSQ

SEQ ID NO: 475 - protein, 49 aa, ARTIFICIAL SEQUENCE
  Engineered FcRn binding polypeptide
KESELAAHEIRWLPNLTFDQRVAFIWKLRDDPSQSSELLSEAKKLNDSQ

SEQ ID NO: 476 - protein, 49 aa, ARTIFICIAL SEQUENCE
  Engineered FcRn binding polypeptide
KEYRAAGHEIRWLPNLTFDQRVAFIHKLRDDPSQSSELLSEAKKLNDSQ

SEQ ID NO: 477 - protein, 49 aa, ARTIFICIAL SEQUENCE
  Engineered FcRn binding polypeptide
KETANAAHEIRWLPNLTFDQRVAFIHKLRDDPSQSSELLSEAKKLNDSQ

SEQ ID NO: 478 - protein, 49 aa, ARTIFICIAL SEQUENCE
  Engineered FcRn binding polypeptide
KEWYEAAHEIRWLPNLTFDQRVAFIHKLRDDPSQSSELLSEAKKLNDSQ

SEQ ID NO: 479 - protein, 49 aa, ARTIFICIAL SEQUENCE
  Engineered FcRn binding polypeptide
KEEQEAAHEIRWLPNLTFDQRVAFIHKLWDDPSQSSELLSEAKKLNDSQ

SEQ ID NO: 480 - protein, 49 aa, ARTIFICIAL SEQUENCE
  Engineered FcRn binding polypeptide
KEHDDAAHEIRWLPNLTFDQRVAFIHKLRDDPSQSSELLSEAKKLNDSQ

SEQ ID NO: 481 - protein, 49 aa, ARTIFICIAL SEQUENCE
  Engineered FcRn binding polypeptide
KEWYSAAHEIRWLPNLTFDQRVAFIHKLRDDPSQSSELLSEAKKLNDSQ

SEQ ID NO: 482 - protein, 49 aa, ARTIFICIAL SEQUENCE
  Engineered FcRn binding polypeptide
KEISDAAHEIRWLPNLTFDQRVAFIHKLRDDPSQSSELLSEAKKLNDSQ

SEQ ID NO: 483 - protein, 49 aa, ARTIFICIAL SEQUENCE
  Engineered FcRn binding polypeptide
KEYTTAAHEIRWLPNLTFDQRVAFIHKLRDDPSQSSELLSEAKKLNDSQ

SEQ ID NO: 484 - protein, 49 aa, ARTIFICIAL SEQUENCE
  Engineered FcRn binding polypeptide
KEISQAAHEIRWLPNLTFDQRVAFIHKLRDDPSQSSELLSEAKKLNDSQ

SEQ ID NO: 485 - protein, 49 aa, ARTIFICIAL SEQUENCE
  Engineered FcRn binding polypeptide
KENDDAAHEIRWLPNLTFDQRVAFIHKLRDDPSQSSELLSEAKKLNDSQ

SEQ ID NO: 486 - protein, 49 aa, ARTIFICIAL SEQUENCE
  Engineered FcRn binding polypeptide
KESEIAGHEIRWLPNLTFDQRVAFIRKLRDDPSQSSELLSEAKKLNDSQ

SEQ ID NO: 487 - protein, 49 aa, ARTIFICIAL SEQUENCE
  Engineered FcRn binding polypeptide
KEQADAAHEIRWLPNLTFDQRVAFIHKLRDDPSQSSELLSEAKKLNDSQ

SEQ ID NO: 488 - protein, 49 aa, ARTIFICIAL SEQUENCE
  Engineered FcRn binding polypeptide
KETESAAHEIRWLPNLTFDQRVAFIHKLRDDPSQSSELLSEAKKLNDSQ

SEQ ID NO: 489 - protein, 49 aa, ARTIFICIAL SEQUENCE
  Engineered FcRn binding polypeptide
KEISDAKHEIRWLPNLTFDQRVAFIHKLDDDPSQSSELLSEAKKLNDSQ

SEQ ID NO: 490 - protein, 49 aa, ARTIFICIAL SEQUENCE
  Engineered FcRn binding polypeptide
KEHLNAAHEIRWLPNLTFDQRVAFIHKLRDDPSQSSELLSEAKKLNDSQ

SEQ ID NO: 491 - protein, 49 aa, ARTIFICIAL SEQUENCE
  Engineered FcRn binding polypeptide
KEWLDAAHEIRWLPNLTFDQRVAFIHKLRDDPSQSSELLSEAKKLNDSQ

SEQ ID NO: 492 - protein, 49 aa, ARTIFICIAL SEQUENCE
  Engineered FcRn binding polypeptide
KENAAAAHEIRWLPNLTFDQRVAFIHKLRDDPSQSSELLSEAKKLNDSQ

SEQ ID NO: 493 - protein, 49 aa, ARTIFICIAL SEQUENCE
  Engineered FcRn binding polypeptide
KEAELAGHEIRWLPNLTFDQRVAFIRKLRDDPSQSSELLSEAKKLNDSQ

SEQ ID NO: 494 - protein, 49 aa, ARTIFICIAL SEQUENCE
  Engineered FcRn binding polypeptide
KEVTDAGHEIRWLPNLTFDQRVAFIEKLKDDPSQSSELLSEAKKLNDSQ

SEQ ID NO: 495 - protein, 49 aa, ARTIFICIAL SEQUENCE
  Engineered FcRn binding polypeptide
KELDSASHEIRWLPNLTFDQRVAFINKLLDDPSQSSELLSEAKKLNDSQ

SEQ ID NO: 496 - protein, 49 aa, ARTIFICIAL SEQUENCE
  Engineered FcRn binding polypeptide
KEINLAKHEIRWLPNLTFDQRVAFIEKLNDDPSQSSELLSEAKKLNDSQ

SEQ ID NO: 497 - protein, 49 aa, ARTIFICIAL SEQUENCE
  Engineered FcRn binding polypeptide
KESEVAKHEIRWLPNLTFDQRVAFIHKLSDDPSQSSELLSEAKKLNDSQ

SEQ ID NO: 498 - protein, 49 aa, ARTIFICIAL SEQUENCE
  Engineered FcRn binding polypeptide
KESAEAGHEIRWLPNLTFDQRVAFIHKLQDDPSQSSELLSEAKKLNDSQ

SEQ ID NO: 499 - protein, 49 aa, ARTIFICIAL SEQUENCE
  Engineered FcRn binding polypeptide
KEYSNAAHEIRWLPNLTFDQRVAFIDKLSDDPSQSSELLSEAKKLNDSQ

SEQ ID NO: 500 - protein, 49 aa, ARTIFICIAL SEQUENCE
  Engineered FcRn binding polypeptide
KETNNAGHEIRWLPNLTFDQRVAFIIKLRDDPSQSSELLSEAKKLNDSQ

SEQ ID NO: 501 - protein, 49 aa, ARTIFICIAL SEQUENCE
  Engineered FcRn binding polypeptide
KEVEFAAHEIRWLPNLTFDQRVAFIHKLNDDPSQSSELLSEAKKLNDSQ

SEQ ID NO: 502 - protein, 49 aa, ARTIFICIAL SEQUENCE
  Engineered FcRn binding polypeptide
KEVELAGHEIRWLPNLTFDQRVAFIEKLHDDPSQSSELLSEAKKLNDSQ

SEQ ID NO: 503 - protein, 49 aa, ARTIFICIAL SEQUENCE
  Engineered FcRn binding polypeptide
KEVLKASHEIRWLPNLTFDQRVAFITKLQDDPSQSSELLSEAKKLNDSQ

SEQ ID NO: 504 - protein, 49 aa, ARTIFICIAL SEQUENCE
  Engineered FcRn binding polypeptide
KEIANAGHEIRWLPNLTFDQRVAFIRKLDDDPSQSSELLSEAKKLNDSQ

SEQ ID NO: 505 - protein, 49 aa, ARTIFICIAL SEQUENCE
  Engineered FcRn binding polypeptide
KEYMKAGHEIRWLPNLTFDQRVAFIVKLRDDPSQSSELLSEAKKLNDSQ

SEQ ID NO: 506 - protein, 49 aa, ARTIFICIAL SEQUENCE
  Engineered FcRn binding polypeptide
KEHANAQHEIRWLPNLTFDQRVAFIHKLQDDPSQSSELLSEAKKLNDSQ

SEQ ID NO: 507 - protein, 49 aa, ARTIFICIAL SEQUENCE
  Engineered FcRn binding polypeptide
KEVDIASHEIRWLPNLTYDQRVAFIWKLRDDPSQSSELLSEAKKLNDSQ

SEQ ID NO: 508 - protein, 49 aa, ARTIFICIAL SEQUENCE
  Engineered FcRn binding polypeptide
KEEVFAAHEIRWLPNLTYDQRVAFIVKLRDDPSQSSELLSEAKKLNDSQ

SEQ ID NO: 509 - protein, 49 aa, ARTIFICIAL SEQUENCE
  Engineered FcRn binding polypeptide
KEFNTAAHEIRWLPNLTFDQRVAFINKLDDDPSQSSELLSEAKKLNDSQ

SEQ ID NO: 510 - protein, 49 aa, ARTIFICIAL SEQUENCE
  Engineered FcRn binding polypeptide
KEVDVAGHEIRWLPNLTFDQRVAFIRKLNDDPSQSSELLSEAKKLNDSQ

SEQ ID NO: 511 - protein, 49 aa, ARTIFICIAL SEQUENCE
  Engineered FcRn binding polypeptide
KEWSLAAHEIRWLPNLTFDQRVAFIVKLRDDPSQSSELLSEAKKLNDSQ

SEQ ID NO: 512 - protein, 49 aa, ARTIFICIAL SEQUENCE
  Engineered FcRn binding polypeptide
KELDDAAHEIRWLPNLTFDQRVAFIQKLQDDPSQSSELLSEAKKLNDSQ

SEQ ID NO: 513 - protein, 49 aa, ARTIFICIAL SEQUENCE
  Engineered FcRn binding polypeptide
KERHEAGHEIRWLPNLTFDQRVAFIRKLNDDPSQSSELLSEAKKLNDSQ

SEQ ID NO: 514 - protein, 49 aa, ARTIFICIAL SEQUENCE
  Engineered FcRn binding polypeptide
KEISDAIHEIRWLPNLTFDQRVAFIHKLQDDPSQSSELLSEAKKLNDSQ

SEQ ID NO: 515 - protein, 49 aa, ARTIFICIAL SEQUENCE
  Engineered FcRn binding polypeptide
KEWETAGHEIRWLPNLTFDQRVAFIVKLSDDPSQSSELLSEAKKLNDSQ

SEQ ID NO: 516 - protein, 49 aa, ARTIFICIAL SEQUENCE
  Engineered FcRn binding polypeptide
KERYWASHEIRWLPNLTFDQRVAFIHKLNDDPSQSSELLSEAKKLNDSQ

SEQ ID NO: 517 - protein, 49 aa, ARTIFICIAL SEQUENCE
  Engineered FcRn binding polypeptide
KEIDWAGHEIRWLPNLTFDQRVAFIHKLLDDPSQSSELLSEAKKLNDSQ

SEQ ID NO: 518 - protein, 49 aa, ARTIFICIAL SEQUENCE
  Engineered FcRn binding polypeptide
KEQSKAGHEIRWLPNLTFDQRVAFIHKLKDDPSQSSELLSEAKKLNDSQ

SEQ ID NO: 519 - protein, 49 aa, ARTIFICIAL SEQUENCE
  Engineered FcRn binding polypeptide
KEIEAAQHEIRWLPNLTFDQRVAFINKLRDDPSQSSELLSEAKKLNDSQ

SEQ ID NO: 520 - protein, 49 aa, ARTIFICIAL SEQUENCE
  Engineered FcRn binding polypeptide
KEHEQAAHEIRWLPNLTFDQRVAFIRKLVDDPSQSSELLSEAKKLNDSQ

SEQ ID NO: 521 - protein, 49 aa, ARTIFICIAL SEQUENCE
  Engineered FcRn binding polypeptide
KEAEQAGHEIRWLPNLTFDQRVAFINKLQDDPSQSSELLSEAKKLNDSQ

SEQ ID NO: 522 - protein, 49 aa, ARTIFICIAL SEQUENCE
  Engineered FcRn binding polypeptide
KEVDYAAHEIRWLPNLTFDQRVAFIHKLWDDPSQSSELLSEAKKLNDSQ

SEQ ID NO: 523 - protein, 49 aa, ARTIFICIAL SEQUENCE
  Engineered FcRn binding polypeptide
KEYSAAGHEIRWLPNLTFDQRVAFIEKLRDDPSQSSELLSEAKKLNDSQ

SEQ ID NO: 524 - protein, 49 aa, ARTIFICIAL SEQUENCE
  Engineered FcRn binding polypeptide
KELATASHEIRWLPNLTFDQRVAFIHKLRDDPSQSSELLSEAKKLNDSQ

SEQ ID NO: 525 - protein, 49 aa, ARTIFICIAL SEQUENCE
  Engineered FcRn binding polypeptide
KEYRVAGHEIRWLPNLTFDQRVAFIQKLRDDPSQSSELLSEAKKLNDSQ

SEQ ID NO: 526 - protein, 49 aa, ARTIFICIAL SEQUENCE
  Engineered FcRn binding polypeptide
KEVVSAKHEIRWLPNLTFDQRVAFIHKLDDDPSQSSELLSEAKKLNDSQ

SEQ ID NO: 527 - protein, 49 aa, ARTIFICIAL SEQUENCE
  Engineered FcRn binding polypeptide
KESAQAAHEIRWLPNLTFDQRVAFIRKLRDDPSQSSELLSEAKKLNDSQ

SEQ ID NO: 528 - protein, 49 aa, ARTIFICIAL SEQUENCE
  Engineered FcRn binding polypeptide
KEYSAAGHEIRWLPNLTFDQRVAFIHKLRDDPSQSSELLSEAKKLNDSQ

SEQ ID NO: 529 - protein, 49 aa, ARTIFICIAL SEQUENCE
  Engineered FcRn binding polypeptide
KEQKEAAAEIRWLPNLTFDQRVAFIHKLRDDPSQSSELLSEAKKLNDSQ

SEQ ID NO: 530 - protein, 49 aa, ARTIFICIAL SEQUENCE
  Engineered FcRn binding polypeptide
KEAAIAGKEIRWLPNLTFDQRVAFIHKLRDDPSQSSELLSEAKKLNDSQ

SEQ ID NO: 531 - protein, 49 aa, ARTIFICIAL SEQUENCE
  Engineered FcRn binding polypeptide
KEISKAKHEIRWLPNLTFDQRVAFIHKLDDDPSQSSELLSEAKKLNDSQ

SEQ ID NO: 532 - protein, 49 aa, ARTIFICIAL SEQUENCE
  Engineered FcRn binding polypeptide
KESVAAAHEIRWLPNLTFDQRVAFIWKLRDDPSQSSELLSEAKKLNDSQ

SEQ ID NO: 533 - protein, 49 aa, ARTIFICIAL SEQUENCE
  Engineered FcRn binding polypeptide
KEIQQAKHEIRWLPNLTFDQRVAFIHKLDDDPSQSSELLSEAKKLNDSQ

SEQ ID NO: 534 - protein, 49 aa, ARTIFICIAL SEQUENCE
  Engineered FcRn binding polypeptide
KEITSAKHEIRWLPNLTFDQRVAFIHKLDDDPSQSSELLSEAKKLNDSQ

SEQ ID NO: 535 - protein, 49 aa, ARTIFICIAL SEQUENCE
  Engineered FcRn binding polypeptide
KEQDVAAHEIRWLPNLTFDQRVAFIRKLRDDPSQSSELLSEAKKLNDSQ

SEQ ID NO: 536 - protein, 49 aa, ARTIFICIAL SEQUENCE
  Engineered FcRn binding polypeptide
KELERAAHEIRWLPNLTFDQRVAFINKLKDDPSQSSELLSEAKKLNDSQ

SEQ ID NO: 537 - protein, 49 aa, ARTIFICIAL SEQUENCE
  Engineered FcRn binding polypeptide
KENQLAAHEIRWLPNLTFDQRVAFIHKLRDDPSQSSELLSEAKKLNDSQ

SEQ ID NO: 538 - protein, 49 aa, ARTIFICIAL SEQUENCE
  Engineered FcRn binding polypeptide
KEISQAKHEIRWLPNLTFDQRVAFIHKLDDDPSQSSELLSEAKKLNDSQ

SEQ ID NO: 539 - protein, 49 aa, ARTIFICIAL SEQUENCE
  Engineered FcRn binding polypeptide
KEIANASHEIRWLPNLTFDQRVAFIYKLRDDPSQSSELLSEAKKLNDSQ

SEQ ID NO: 540 - protein, 49 aa, ARTIFICIAL SEQUENCE
  Engineered FcRn binding polypeptide
KEWQAAAHEIRWLPNLTFDQRVAFIRKLRDDPSQSSELLSEAKKLNDSQ

SEQ ID NO: 541 - protein, 49 aa, ARTIFICIAL SEQUENCE
  Engineered FcRn binding polypeptide
KERKDAGHEIRWLPNLTFDQRVAFIRKLRDDPSQSSELLSEAKKLNDSQ

SEQ ID NO: 542 - protein, 49 aa, ARTIFICIAL SEQUENCE
  Engineered FcRn binding polypeptide
KEITQAKHEIRWLPNLTFDQRVAFIHKLDDDPSQSSELLSEAKKLNDSQ

SEQ ID NO: 543 - protein, 49 aa, ARTIFICIAL SEQUENCE
  Engineered FcRn binding polypeptide
KEFIQAGHEIRWLPNLTFDQRVAFIHKLRDDPSQSSELLSEAKKLNDSQ

SEQ ID NO: 544 - protein, 49 aa, ARTIFICIAL SEQUENCE
  Engineered FcRn binding polypeptide
KEWNTASHEIRWLPNLTFDQRVAFIHKLRDDPSQSSELLSEAKKLNDSQ

SEQ ID NO: 545 - protein, 49 aa, ARTIFICIAL SEQUENCE
  Engineered FcRn binding polypeptide
KEKFVAAHEIRWLPNLTFDQRVAFIHKLKDDPSQSSELLSEAKKLNDSQ

SEQ ID NO: 546 - protein, 49 aa, ARTIFICIAL SEQUENCE
  Engineered FcRn binding polypeptide
KEADSAGAEIRWLPNLTFDQRVAFIHKLRDDPSQSSELLSEAKKLNDSQ

SEQ ID NO: 547 - protein, 49 aa, ARTIFICIAL SEQUENCE
  Engineered FcRn binding polypeptide
KESSVAAAEIRWLPNLTFDQRVAFIHKLRDDPSQSSELLSEAKKLNDSQ

SEQ ID NO: 548 - protein, 49 aa, ARTIFICIAL SEQUENCE
  Engineered FcRn binding polypeptide
KEVDLAGREIRWLPNLTFDQRVAFIHKLRDDPSQSSELLSEAKKLNDSQ

SEQ ID NO: 549 - protein, 49 aa, ARTIFICIAL SEQUENCE
  Engineered FcRn binding polypeptide
KEQERAAAEIRWLPNLTFDQRVAFIHKLRDDPSQSSELLSEAKKLNDSQ

SEQ ID NO: 550 - protein, 49 aa, ARTIFICIAL SEQUENCE
  Engineered FcRn binding polypeptide
KEIWQAKHEIRWLPNLTFDQRVAFIHKLDDDPSQSSELLSEAKKLNDSQ

SEQ ID NO: 551 - protein, 49 aa, ARTIFICIAL SEQUENCE
  Engineered FcRn binding polypeptide
KELNQAKHEIRWLPNLTFDQRVAFIHKLEDDPSQSSELLSEAKKLNDSQ

SEQ ID NO: 552 - protein, 49 aa, ARTIFICIAL SEQUENCE
  Engineered FcRn binding polypeptide
KELQQASHEIRWLPNLTFDQRVAFIHKLRDDPSQSSELLSEAKKLNDSQ

SEQ ID NO: 553 - protein, 49 aa, ARTIFICIAL SEQUENCE
  Engineered FcRn binding polypeptide
KEINQAKHEIRWLPNLTFDQRVAFIHKLDDDPSQSSELLSEAKKLNDSQ

SEQ ID NO: 554 - protein, 49 aa, ARTIFICIAL SEQUENCE
  Engineered FcRn binding polypeptide
KELVLAGHEIRWLPNLTFDQRVAFIHKLRDDPSQSSELLSEAKKLNDSQ

SEQ ID NO: 555 - protein, 49 aa, ARTIFICIAL SEQUENCE
  Engineered FcRn binding polypeptide
KELTSAAHEIRWLPNLTFDQRVAFIHKLRDDPSQSSELLSEAKKLNDSQ

SEQ ID NO: 556 - protein, 49 aa, ARTIFICIAL SEQUENCE
  Engineered FcRn binding polypeptide
KEWNAAAREIRWLPNLTFDQRVAFIHKLRDDPSQSSELLSEAKKLNDSQ

SEQ ID NO: 557 - protein, 49 aa, ARTIFICIAL SEQUENCE
  Engineered FcRn binding polypeptide
KEILHAKHEIRWLPNLTFDQRVAFIHKLDDDPSQSSELLSEAKKLNDSQ

SEQ ID NO: 558 - protein, 49 aa, ARTIFICIAL SEQUENCE
  Engineered FcRn binding polypeptide
KEVLTAKHEIRWLPNLTFDQRVAFIHKLNDDPSQSSELLSEAKKLNDSQ

SEQ ID NO: 559 - protein, 49 aa, ARTIFICIAL SEQUENCE
  Engineered FcRn binding polypeptide
KENSKAAHEIRWLPNLTFDQRVAFIHKLADDPSQSSELLSEAKKLNDSQ

SEQ ID NO: 560 - protein, 49 aa, ARTIFICIAL SEQUENCE
  Engineered FcRn binding polypeptide
KEVMTAKHEIRWLPNLTFDQRVAFIHKLDDDPSQSSELLSEAKKLNDSQ

SEQ ID NO: 561 - protein, 49 aa, ARTIFICIAL SEQUENCE
  Engineered FcRn binding polypeptide
KEARDAAHEIRWLPNLTFDQRVAFIHKLSDDPSQSSELLSEAKKLNDSQ

SEQ ID NO: 562 - protein, 49 aa, ARTIFICIAL SEQUENCE
  Engineered FcRn binding polypeptide
KERSKAAHEIRWLPNLTFDQRVAFIHKLKDDPSQSSELLSEAKKLNDSQ

SEQ ID NO: 563 - protein, 49 aa, ARTIFICIAL SEQUENCE
  Engineered FcRn binding polypeptide
KEIYSAKHEIRWLPNLTFDQRVAFIHKLDDDPSQSSELLSEAKKLNDSQ

SEQ ID NO: 564 - protein, 49 aa, ARTIFICIAL SEQUENCE
  Engineered FcRn binding polypeptide
KEVQSAKHEIRWLPNLTFDQRVAFIHKLDDDPSQSSELLSEAKKLNDSQ

SEQ ID NO: 565 - protein, 49 aa, ARTIFICIAL SEQUENCE
  Engineered FcRn binding polypeptide
KETLEAAHEIRWLPNLTFDQRVAFIHKLKDDPSQSSELLSEAKKLNDSQ

SEQ ID NO: 566 - protein, 49 aa, ARTIFICIAL SEQUENCE
  Engineered FcRn binding polypeptide
KEQMRAAHEIRWLPNLTFDQRVAFIRKLRDDPSQSSELLSEAKKLNDSQ

SEQ ID NO: 567 - protein, 49 aa, ARTIFICIAL SEQUENCE
  Engineered FcRn binding polypeptide
KENKNAAHEIRWLPNLTFDQRVAFIHKLRDDPSQSSELLSEAKKLNDSQ

SEQ ID NO: 568 - protein, 49 aa, ARTIFICIAL SEQUENCE
  Engineered FcRn binding polypeptide
KETESAKHEIRWLPNLTFDQRVAFIHKLTDDPSQSSELLSEAKKLNDSQ

SEQ ID NO: 569 - protein, 49 aa, ARTIFICIAL SEQUENCE
  Engineered FcRn binding polypeptide
KETVQAKHEIRWLPNLTFDQRVAFIHKLDDDPSQSSELLSEAKKLNDSQ

SEQ ID NO: 570 - protein, 49 aa, ARTIFICIAL SEQUENCE
  Engineered FcRn binding polypeptide
KEIASAKHEIRWLPNLTFDQRVAFIHKLDDDPSQSSELLSEAKKLNDSQ

SEQ ID NO: 571 - protein, 49 aa, ARTIFICIAL SEQUENCE
  Engineered FcRn binding polypeptide
KEVMDAKHEIRWLPNLTFDQRVAFIHKLDDDPSQSSELLSEAKKLNDSQ

SEQ ID NO: 572 - protein, 49 aa, ARTIFICIAL SEQUENCE
  Engineered FcRn binding polypeptide
KETDAAKHEIRWLPNLTFDQRVAFIHKLRDDPSQSSELLSEAKKLNDSQ

SEQ ID NO: 573 - protein, 49 aa, ARTIFICIAL SEQUENCE
  Engineered FcRn binding polypeptide
KELQIAKHEIRWLPNLTFDQRVAFIHKLDDDPSQSSELLSEAKKLNDSQ

SEQ ID NO: 574 - protein, 49 aa, ARTIFICIAL SEQUENCE
  Engineered FcRn binding polypeptide
KEWKDAAQEIRWLPNLTFDQRVAFIHKLRDDPSQSSELLSEAKKLNDSQ

SEQ ID NO: 575 - protein, 49 aa, ARTIFICIAL SEQUENCE
  Engineered FcRn binding polypeptide
KERDSAAHEIRWLPNLTFDQRVAFIRKLRDDPSQSSELLSEAKKLNDSQ

SEQ ID NO: 576 - protein, 49 aa, ARTIFICIAL SEQUENCE
  Engineered FcRn binding polypeptide
KEIAAAKHEIRWLPNLTFDQRVAFIHKLDDDPSQSSELLSEAKKLNDSQ

SEQ ID NO: 577 - protein, 49 aa, ARTIFICIAL SEQUENCE
  Engineered FcRn binding polypeptide
KESVKAKHEIRWLPNLTFDQRVAFIHKLDDDPSQSSELLSEAKKLNDSQ

SEQ ID NO: 578 - protein, 49 aa, ARTIFICIAL SEQUENCE
  Engineered FcRn binding polypeptide
KENERAKHEIRWLPNLTFDQRVAFIHKLDDDPSQSSELLSEAKKLNDSQ

SEQ ID NO: 579 - protein, 49 aa, ARTIFICIAL SEQUENCE
  Engineered FcRn binding polypeptide
KEYKRAGHEIRWLPNLTFDQRVAFIRKLRDDPSQSSELLSEAKKLNDSQ

SEQ ID NO: 580 - protein, 49 aa, ARTIFICIAL SEQUENCE
  Engineered FcRn binding polypeptide
KEVRAASHEIRWLPNLTFDQRVAFIHKLRDDPSQSSELLSEAKKLNDSQ

SEQ ID NO: 581 - protein, 49 aa, ARTIFICIAL SEQUENCE
  Engineered FcRn binding polypeptide
KEDKRAAHEIRWLPNLTFDQRVAFIRKLRDDPSQSSELLSEAKKLNDSQ

SEQ ID NO: 582 - protein, 49 aa, ARTIFICIAL SEQUENCE
  Engineered FcRn binding polypeptide
KESEKAGKEIRWLPNLTFDQRVAFIRKLRDDPSQSSELLSEAKKLNDSQ

SEQ ID NO: 583 - protein, 49 aa, ARTIFICIAL SEQUENCE
  Engineered FcRn binding polypeptide
KEINRAKHEIRWLPNLTFDQRVAFIHKLDDDPSQSSELLSEAKKLNDSQ

SEQ ID NO: 584 - protein, 49 aa, ARTIFICIAL SEQUENCE
  Engineered FcRn binding polypeptide
KETQQASHEIRWLPNLTFDQRVAFIHKLRDDPSQSSELLSEAKKLNDSQ

SEQ ID NO: 585 - protein, 49 aa, ARTIFICIAL SEQUENCE
  Engineered FcRn binding polypeptide
KENQSAAHEIRWLPNLTFDQRVAFIRKLRDDPSQSSELLSEAKKLNDSQ

SEQ ID NO: 586 - protein, 49 aa, ARTIFICIAL SEQUENCE
  Engineered FcRn binding polypeptide
KEAKQASHEIRWLPNLTFDQRVAFIVKLRDDPSQSSELLSEAKKLNDSQ

SEQ ID NO: 587 - protein, 49 aa, ARTIFICIAL SEQUENCE
  Engineered FcRn binding polypeptide
KEAAQAAHEIRWLPNLTFDQRVAFIHKLRDDPSQSSELLSEAKKLNDSQ

SEQ ID NO: 588 - protein, 49 aa, ARTIFICIAL SEQUENCE
  Engineered FcRn binding polypeptide
KEVQYASHEIRWLPNLTFDQRVAFIHKLRDDPSQSSELLSEAKKLNDSQ

SEQ ID NO: 589 - protein, 49 aa, ARTIFICIAL SEQUENCE
  Engineered FcRn binding polypeptide
KELRNAAHEIRWLPNLTFDQRVAFIHKLRDDPSQSSELLSEAKKLNDSQ

SEQ ID NO: 590 - protein, 49 aa, ARTIFICIAL SEQUENCE
  Engineered FcRn binding polypeptide
KEQRAAAHEIRWLPNLTFDQRVAFIHKLRDDPSQSSELLSEAKKLNDSQ

SEQ ID NO: 591 - protein, 49 aa, ARTIFICIAL SEQUENCE
  Engineered FcRn binding polypeptide
KEASEAAAEIRWLPNLTFDQRVAFIHKLRDDPSQSSELLSEAKKLNDSQ

SEQ ID NO: 592 - protein, 49 aa, ARTIFICIAL SEQUENCE
  Engineered FcRn binding polypeptide
KESVIAAHEIRWLPNLTFDQRVAFIHKLRDDPSQSSELLSEAKKLNDSQ

SEQ ID NO: 593 - protein, 49 aa, ARTIFICIAL SEQUENCE
  Engineered FcRn binding polypeptide
KEILRAKHEIRWLPNLTFDQRVAFIHKLDDDPSQSSELLSEAKKLNDSQ

SEQ ID NO: 594 - protein, 49 aa, ARTIFICIAL SEQUENCE
  Engineered FcRn binding polypeptide
KESKTAAHEIRWLPNLTFDQRVAFIQKLRDDPSQSSELLSEAKKLNDSQ

SEQ ID NO: 595 - protein, 49 aa, ARTIFICIAL SEQUENCE
  Engineered FcRn binding polypeptide
KELAEASHEIRWLPNLTFDQRVAFIHKLFDDPSQSSELLSEAKKLNDSQ

SEQ ID NO: 596 - protein, 49 aa, ARTIFICIAL SEQUENCE
  Engineered FcRn binding polypeptide
KEATTAKHEIRWLPNLTFDQRVAFIHKLDDDPSQSSELLSEAKKLNDSQ

SEQ ID NO: 597 - protein, 49 aa, ARTIFICIAL SEQUENCE
  Engineered FcRn binding polypeptide
KEIENAAHEIRWLPNLTFDQRVAFIHKLRDDPSQSSELLSEAKKLNDSQ

SEQ ID NO: 598 - protein, 49 aa, ARTIFICIAL SEQUENCE
  Engineered FcRn binding polypeptide
KEAKDAAHEIRWLPNLTFDQRVAFIRKLRDDPSQSSELLSEAKKLNDSQ

SEQ ID NO: 599 - protein, 49 aa, ARTIFICIAL SEQUENCE
  Engineered FcRn binding polypeptide
KERLEAAAEIRWLPNLTFDQRVAFIHKLRDDPSQSSELLSEAKKLNDSQ

SEQ ID NO: 600 - protein, 49 aa, ARTIFICIAL SEQUENCE
  Engineered FcRn binding polypeptide
KEQMEAAAEIRWLPNLTFDQRVAFIHKLRDDPSQSSELLSEAKKLNDSQ

SEQ ID NO: 601 - protein, 49 aa, ARTIFICIAL SEQUENCE
  Engineered FcRn binding polypeptide
KEVKTASHEIRWLPNLTFDQRVAFIRKLRDDPSQSSELLSEAKKLNDSQ

SEQ ID NO: 602 - protein, 49 aa, ARTIFICIAL SEQUENCE
  Engineered FcRn binding polypeptide
KESFEASHEIRWLPNLTFDQRVAFIQKLRDDPSQSSELLSEAKKLNDSQ

SEQ ID NO: 603 - protein, 49 aa, ARTIFICIAL SEQUENCE
  Engineered FcRn binding polypeptide
KEIKSAKHEIRWLPNLTFDQRVAFIHKLDDDPSQSSELLSEAKKLNDSQ

SEQ ID NO: 604 - protein, 49 aa, ARTIFICIAL SEQUENCE
  Engineered FcRn binding polypeptide
KEIKNAKHEIRWLPNLTFDQRVAFIHKLDDDPSQSSELLSEAKKLNDSQ

SEQ ID NO: 605 - protein, 49 aa, ARTIFICIAL SEQUENCE
  Engineered FcRn binding polypeptide
KELQEAKHEIRWLPNLTFDQRVAFIHKLDDDPSQSSELLSEAKKLNDSQ

SEQ ID NO: 606 - protein, 49 aa, ARTIFICIAL SEQUENCE
  Engineered FcRn binding polypeptide
KERQNAAHEIRWLPNLTFDQRVAFIRKLRDDPSQSSELLSEAKKLNDSQ

SEQ ID NO: 607 - protein, 49 aa, ARTIFICIAL SEQUENCE
  Engineered FcRn binding polypeptide
KEVLQAKHEIRWLPNLTFDQRVAFIHKLDDDPSQSSELLSEAKKLNDSQ

SEQ ID NO: 608 - protein, 49 aa, ARTIFICIAL SEQUENCE
  Engineered FcRn binding polypeptide
KEANVASHEIRWLPNLTFDQRVAFIHKLRDDPSQSSELLSEAKKLNDSQ

SEQ ID NO: 609 - protein, 49 aa, ARTIFICIAL SEQUENCE
  Engineered FcRn binding polypeptide
KELDAAKHEIRWLPNLTFDQRVAFIHKLDDDPSQSSELLSEAKKLNDSQ

SEQ ID NO: 610 - protein, 49 aa, ARTIFICIAL SEQUENCE
  Engineered FcRn binding polypeptide
KETASAAHEIRWLPNLTFDQRVAFIHKLNDDPSQSSELLSEAKKLNDSQ

SEQ ID NO: 611 - protein, 49 aa, ARTIFICIAL SEQUENCE
  Engineered FcRn binding polypeptide
KEWKQAASEIRWLPNLTFDQRVAFIHKLRDDPSQSSELLSEAKKLNDSQ

SEQ ID NO: 612 - protein, 49 aa, ARTIFICIAL SEQUENCE
  Engineered FcRn binding polypeptide
KETASASHEIRWLPNLTFDQRVAFIHKLQDDPSQSSELLSEAKKLNDSQ

SEQ ID NO: 613 - protein, 49 aa, ARTIFICIAL SEQUENCE
  Engineered FcRn binding polypeptide
KESIVAGHEIRWLPNLTFDQRVAFIHKLRDDPSQSSELLSEAKKLNDSQ

SEQ ID NO: 614 - protein, 49 aa, ARTIFICIAL SEQUENCE
  Engineered FcRn binding polypeptide
KEIKQAKHEIRWLPNLTFDQRVAFIHKLDDDPSQSSELLSEAKKLNDSQ

SEQ ID NO: 615 - protein, 49 aa, ARTIFICIAL SEQUENCE
  Engineered FcRn binding polypeptide
KEQATASHEIRWLPNLTFDQRVAFIRKLRDDPSQSSELLSEAKKLNDSQ

SEQ ID NO: 616 - protein, 49 aa, ARTIFICIAL SEQUENCE
  Engineered FcRn binding polypeptide
KELNAAKHEIRWLPNLTFDQRVAFIHKLDDDPSQSSELLSEAKKLNDSQ

SEQ ID NO: 617 - protein, 49 aa, ARTIFICIAL SEQUENCE
  Engineered FcRn binding polypeptide
KEVKRAGHEIRWLPNLTFDQRVAFIRKLRDDPSQSSELLSEAKKLNDSQ

SEQ ID NO: 618 - protein, 49 aa, ARTIFICIAL SEQUENCE
  Engineered FcRn binding polypeptide
KESRNAAHEIRWLPNLTFDQRVAFIHKLQDDPSQSSELLSEAKKLNDSQ

SEQ ID NO: 619 - protein, 49 aa, ARTIFICIAL SEQUENCE
  Engineered FcRn binding polypeptide
KESITASAEIRWLPNLTFDQRVAFIRKLRDDPSQSSELLSEAKKLNDSQ

SEQ ID NO: 620 - protein, 49 aa, ARTIFICIAL SEQUENCE
  Engineered FcRn binding polypeptide
KEAATAAHEIRWLPNLTFDQRVAFIHKLQDDPSQSSELLSEAKKLNDSQ

SEQ ID NO: 621 - protein, 49 aa, ARTIFICIAL SEQUENCE
  Engineered FcRn binding polypeptide
KEVYAAKHEIRWLPNLTFDQRVAFIHKLDDDPSQSSELLSEAKKLNDSQ

SEQ ID NO: 622 - protein, 49 aa, ARTIFICIAL SEQUENCE
  Engineered FcRn binding polypeptide
KEISRAKHEIRWLPNLTFDQRVAFIHKLDDDPSQSSELLSEAKKLNDSQ

SEQ ID NO: 623 - protein, 49 aa, ARTIFICIAL SEQUENCE
  Engineered FcRn binding polypeptide
KEYVTAAHEIRWLPNLTFDQRVAFIHKLRDDPSQSSELLSEAKKLNDSQ

SEQ ID NO: 624 - protein, 49 aa, ARTIFICIAL SEQUENCE
  Engineered FcRn binding polypeptide
KEHIDAGHEIRWLPNLTFDQRVAFIHKLRDDPSQSSELLSEAKKLNDSQ

SEQ ID NO: 625 - protein, 49 aa, ARTIFICIAL SEQUENCE
  Engineered FcRn binding polypeptide
KEILQAKHEIRWLPNLTFDQRVAFIHKLNDDPSQSSELLSEAKKLNDSQ

SEQ ID NO: 626 - protein, 49 aa, ARTIFICIAL SEQUENCE
  Engineered FcRn binding polypeptide
KENSQAKHEIRWLPNLTFDQRVAFIHKLNDDPSQSSELLSEAKKLNDSQ

SEQ ID NO: 627 - protein, 49 aa, ARTIFICIAL SEQUENCE
  Engineered FcRn binding polypeptide
KEYRVAAKEIRWLPNLTFDQRVAFIHKLRDDPSQSSELLSEAKKLNDSQ

SEQ ID NO: 628 - protein, 49 aa, ARTIFICIAL SEQUENCE
  Engineered FcRn binding polypeptide
KEIYNAGHEIRWLPNLTFDQRVAFIRKLRDDPSQSSELLSEAKKLNDSQ

SEQ ID NO: 629 - protein, 49 aa, ARTIFICIAL SEQUENCE
  Engineered FcRn binding polypeptide
KESNEAAAEIRWLPNLTFDQRVAFIHKLRDDPSQSSELLSEAKKLNDSQ

SEQ ID NO: 630 - protein, 49 aa, ARTIFICIAL SEQUENCE
  Engineered FcRn binding polypeptide
KESQLAAAEIRWLPNLTFDQRVAFIRKLRDDPSQSSELLSEAKKLNDSQ

SEQ ID NO: 631 - protein, 49 aa, ARTIFICIAL SEQUENCE
  Engineered FcRn binding polypeptide
KELKEAGHEIRWLPNLTFDQRVAFIHKLQDDPSQSSELLSEAKKLNDSQ

SEQ ID NO: 632 - protein, 49 aa, ARTIFICIAL SEQUENCE
  Engineered FcRn binding polypeptide
KETRVASVEIRWLPNLTFDQRVAFIQKLNDDPSQSSELLSEAKKLNDSQ

SEQ ID NO: 633 - protein, 49 aa, ARTIFICIAL SEQUENCE
  Engineered FcRn binding polypeptide
KELRTAAHEIRWLPNLTFDQRVAFIHKLNDDPSQSSELLSEAKKLNDSQ

SEQ ID NO: 634 - protein, 49 aa, ARTIFICIAL SEQUENCE
  Engineered FcRn binding polypeptide
KEKTYAHFEIRWLPNLTFDQRVAFISKLWDDPSQSSELLSEAKKLNDSQ

SEQ ID NO: 635 - protein, 49 aa, ARTIFICIAL SEQUENCE
  Engineered FcRn binding polypeptide
KEEAQASHEIRWLPNLTFDQRVAFIHKLRDDPSQSSELLSEAKKLNDSQ

SEQ ID NO: 636 - protein, 49 aa, ARTIFICIAL SEQUENCE
  Engineered FcRn binding polypeptide
KEITSAAHEIRWLPNLTFDQRVAFIHKLRDDPSQSSELLSEAKKLNDSQ

SEQ ID NO: 637 - protein, 49 aa, ARTIFICIAL SEQUENCE
  Engineered FcRn binding polypeptide
KEVKTASHEIRWLPNLTFDQRVAFIHKLKDDPSQSSELLSEAKKLNDSQ

SEQ ID NO: 638 - protein, 49 aa, ARTIFICIAL SEQUENCE
  Engineered FcRn binding polypeptide
KETKVAAHEIRWLPNLTFDQRVAFIHKLRDDPSQSSELLSEAKKLNDSQ

SEQ ID NO: 639 - protein, 49 aa, ARTIFICIAL SEQUENCE
  Engineered FcRn binding polypeptide
KEDLVAQHEIRWLPNLTFDQRVAFIRKLRDDPSQSSELLSEAKKLNDSQ

SEQ ID NO: 640 - protein, 49 aa, ARTIFICIAL SEQUENCE
  Engineered FcRn binding polypeptide
KETQTAFNEIRWLPNLTYDQRAAFILKLWDDPSQSSELLSEAKKLNDSQ

SEQ ID NO: 641 - protein, 49 aa, ARTIFICIAL SEQUENCE
  Engineered FcRn binding polypeptide
KEIKDAGHEIRWLPNLTFDQRVAFIRKLRDDPSQSSELLSEAKKLNDSQ

SEQ ID NO: 642 - protein, 49 aa, ARTIFICIAL SEQUENCE
  Engineered FcRn binding polypeptide
KEYKEAGHEIRWLPNLTYDQRVAFIVKLRDDPSQSSELLSEAKKLNDSQ

SEQ ID NO: 643 - protein, 49 aa, ARTIFICIAL SEQUENCE
  Engineered FcRn binding polypeptide
KEAALAAHEIRWLPNLTFDQRVAFIHKLKDDPSQSSELLSEAKKLNDSQ

SEQ ID NO: 644 - protein, 49 aa, ARTIFICIAL SEQUENCE
  Engineered FcRn binding polypeptide
KEQERAAHEIRWLPNLTFDQRVAFIRKLRDDPSQSSELLSEAKKLNDSQ

SEQ ID NO: 645 - protein, 49 aa, ARTIFICIAL SEQUENCE
  Engineered FcRn binding polypeptide
KEWFDAAHEIRWLPNLTFDQRVAFIRKLRDDPSQSSELLSEAKKLNDSQ

SEQ ID NO: 646 - protein, 49 aa, ARTIFICIAL SEQUENCE
  Engineered FcRn binding polypeptide
KEIIQAKHEIRWLPNLTFDQRVAFIHKLDDDPSQSSELLSEAKKLNDSQ

SEQ ID NO: 647 - protein, 49 aa, ARTIFICIAL SEQUENCE
  Engineered FcRn binding polypeptide
KELTNAKHEIRWLPNLTFDQRVAFIHKLDDDPSQSSELLSEAKKLNDSQ

SEQ ID NO: 648 - protein, 49 aa, ARTIFICIAL SEQUENCE
  Engineered FcRn binding polypeptide
KEIQLAKHEIRWLPNLTFDQRVAFIHKLDDDPSQSSELLSEAKKLNDSQ

SEQ ID NO: 649 - protein, 49 aa, ARTIFICIAL SEQUENCE
  Engineered FcRn binding polypeptide
KEIHDAKHEIRWLPNLTFDQRVAFIHKLQDDPSQSSELLSEAKKLNDSQ

SEQ ID NO: 650 - protein, 49 aa, ARTIFICIAL SEQUENCE
  Engineered FcRn binding polypeptide
KEVKIASHEIRWLPNLTFDQRVAFIHKLRDDPSQSSELLSEAKKLNDSQ

SEQ ID NO: 651 - protein, 49 aa, ARTIFICIAL SEQUENCE
  Engineered FcRn binding polypeptide
KEQHSAAHEIRWLPNLTFDQRVAFIRKLRDDPSQSSELLSEAKKLNDSQ

SEQ ID NO: 652 - protein, 49 aa, ARTIFICIAL SEQUENCE
  Engineered FcRn binding polypeptide
KEVFAASAEIRWLPNLTFDQRVAFIHKLRDDPSQSSELLSEAKKLNDSQ

SEQ ID NO: 653 - protein, 49 aa, ARTIFICIAL SEQUENCE
  Engineered FcRn binding polypeptide
KETDLAGHEIRWLPNLTFDQRVAFIRKLRDDPSQSSELLSEAKKLNDSQ

SEQ ID NO: 654 - protein, 49 aa, ARTIFICIAL SEQUENCE
  Engineered FcRn binding polypeptide
KEANFAGHEIRWLPNLTFDQRVAFIRKLRDDPSQSSELLSEAKKLNDSQ

SEQ ID NO: 655 - protein, 49 aa, ARTIFICIAL SEQUENCE
  Engineered FcRn binding polypeptide
KEFETAGHEIRWLPNLTFDQRVAFITKLWDDPSQSSELLSEAKKLNDSQ

SEQ ID NO: 656 - protein, 49 aa, ARTIFICIAL SEQUENCE
  Engineered FcRn binding polypeptide
KEVNLAKHEIRWLPNLTFDQRVAFIHKLDDDPSQSSELLSEAKKLNDSQ

SEQ ID NO: 657 - protein, 49 aa, ARTIFICIAL SEQUENCE
  Engineered FcRn binding polypeptide
KEADTAAHEIRWLPNLTFDQRVAFIYKLRDDPSQSSELLSEAKKLNDSQ

SEQ ID NO: 658 - protein, 49 aa, ARTIFICIAL SEQUENCE
  Engineered FcRn binding polypeptide
KEFVDAGHEIRWLPNLTFDQRVAFIQKLRDDPSQSSELLSEAKKLNDSQ

SEQ ID NO: 659 - protein, 49 aa, ARTIFICIAL SEQUENCE
  Engineered FcRn binding polypeptide
KEDHKAEHEIRWLPNLTFDQRVAFIHKLRDDPSQSSELLSEAKKLNDSQ

SEQ ID NO: 660 - protein, 49 aa, ARTIFICIAL SEQUENCE
  Engineered FcRn binding polypeptide
KETVDAGHEIRWLPNLTFDQRVAFIHKLADDPSQSSELLSEAKKLNDSQ

SEQ ID NO: 661 - protein, 49 aa, ARTIFICIAL SEQUENCE
  Engineered FcRn binding polypeptide
KESQRAGHEIRWLPNLTFDQRVAFITKLRDDPSQSSELLSEAKKLNDSQ

SEQ ID NO: 662 - protein, 49 aa, ARTIFICIAL SEQUENCE
  Engineered FcRn binding polypeptide
KEWSSAAHEIRWLPNLTFDQRVAFIHKLQDDPSQSSELLSEAKKLNDSQ

SEQ ID NO: 663 - protein, 49 aa, ARTIFICIAL SEQUENCE
  Engineered FcRn binding polypeptide
KEVAVAGHEIRWLPNLTYDQRVAFIVKLRDDPSQSSELLSEAKKLNDSQ

SEQ ID NO: 664 - protein, 49 aa, ARTIFICIAL SEQUENCE
  Engineered FcRn binding polypeptide
KESAEAGHEIRWLPNLTFDQRVAFIEKLRDDPSQSSELLSEAKKLNDSQ

SEQ ID NO: 665 - protein, 49 aa, ARTIFICIAL SEQUENCE
  Engineered FcRn binding polypeptide
KEAVAAGHEIRWLPNLTFDQRVAFIHKLNDDPSQSSELLSEAKKLNDSQ

SEQ ID NO: 666 - protein, 49 aa, ARTIFICIAL SEQUENCE
  Engineered FcRn binding polypeptide
KEFQIAGHEIRWLPNLTFDQRVAFINKLRDDPSQSSELLSEAKKLNDSQ

SEQ ID NO: 667 - protein, 49 aa, ARTIFICIAL SEQUENCE
  Engineered FcRn binding polypeptide
KELMVAKHEIRWLPNLTFDQRVAFIHKLDDDPSQSSELLSEAKKLNDSQ

SEQ ID NO: 668 - protein, 49 aa, ARTIFICIAL SEQUENCE
  Engineered FcRn binding polypeptide
KEYDSAAHEIRWLPNLTYDQRVAFILKLRDDPSQSSELLSEAKKLNDSQ

SEQ ID NO: 669 - protein, 49 aa, ARTIFICIAL SEQUENCE
  Engineered FcRn binding polypeptide
KEVLEAKHEIRWLPNLTFDQRVAFIHKLDDDPSQSSELLSEAKKLNDSQ

SEQ ID NO: 670 - protein, 49 aa, ARTIFICIAL SEQUENCE
  Engineered FcRn binding polypeptide
KESIAASHEIRWLPNLTFDQRVAFIHKLRDDPSQSSELLSEAKKLNDSQ

SEQ ID NO: 671 - protein, 49 aa, ARTIFICIAL SEQUENCE
  Engineered FcRn binding polypeptide
KEVAEAGHEIRWLPNLTFDQRVAFISKLRDDPSQSSELLSEAKKLNDSQ

SEQ ID NO: 672 - protein, 49 aa, ARTIFICIAL SEQUENCE
  Engineered FcRn binding polypeptide
KEQAKAAHEIRWLPNLTFDQRVAFIHKLNDDPSQSSELLSEAKKLNDSQ

SEQ ID NO: 673 - protein, 49 aa, ARTIFICIAL SEQUENCE
  Engineered FcRn binding polypeptide
KERDDAAHEIRWLPNLTFDQRVAFIEKLRDDPSQSSELLSEAKKLNDSQ

SEQ ID NO: 674 - protein, 49 aa, ARTIFICIAL SEQUENCE
  Engineered FcRn binding polypeptide
KEAKDASHEIRWLPNLTFDQRVAFIHKLRDDPSQSSELLSEAKKLNDSQ

SEQ ID NO: 675 - protein, 49 aa, ARTIFICIAL SEQUENCE
  Engineered FcRn binding polypeptide
KEASSAAHEIRWLPNLTFDQRVAFIQKLRDDPSQSSELLSEAKKLNDSQ

SEQ ID NO: 676 - protein, 49 aa, ARTIFICIAL SEQUENCE
  Engineered FcRn binding polypeptide
KEWMEASHEIRWLPNLTYDQRVAFIVKLRDDPSQSSELLSEAKKLNDSQ

SEQ ID NO: 677 - protein, 49 aa, ARTIFICIAL SEQUENCE
  Engineered FcRn binding polypeptide
KEQKNAAHEIRWLPNLTFDQRVAFIEKLRDDPSQSSELLSEAKKLNDSQ

SEQ ID NO: 678 - protein, 49 aa, ARTIFICIAL SEQUENCE
  Engineered FcRn binding polypeptide
KEIENAKHEIRWLPNLTFDQRVAFIHKLDDDPSQSSELLSEAKKLNDSQ

SEQ ID NO: 679 - protein, 49 aa, ARTIFICIAL SEQUENCE
  Engineered FcRn binding polypeptide
KEVNRASHEIRWLPNLTFDQRVAFIHKLLDDPSQSSELLSEAKKLNDSQ

SEQ ID NO: 680 - protein, 49 aa, ARTIFICIAL SEQUENCE
  Engineered FcRn binding polypeptide
KERLLAGHEIRWLPNLTFDQRVAFINKLRDDPSQSSELLSEAKKLNDSQ

SEQ ID NO: 681 - protein, 49 aa, ARTIFICIAL SEQUENCE
  Engineered FcRn binding polypeptide
KEVSIAGHEIRWLPNLTFDQRVAFIRKLRDDPSQSSELLSEAKKLNDSQ

SEQ ID NO: 682 - protein, 49 aa, ARTIFICIAL SEQUENCE
  Engineered FcRn binding polypeptide
KEKEVAAHEIRWLPNLTFDQRVAFIHKLDDDPSQSSELLSEAKKLNDSQ

SEQ ID NO: 683 - protein, 49 aa, ARTIFICIAL SEQUENCE
  Engineered FcRn binding polypeptide
KESERASHEIRWLPNLTFDQRVAFIHKLRDDPSQSSELLSEAKKLNDSQ

SEQ ID NO: 684 - protein, 49 aa, ARTIFICIAL SEQUENCE
  Engineered FcRn binding polypeptide
KEWNEAAHEIRWLPNLTFDQRVAFIHKLRDDPSQSSELLSEAKKLNDSQ

SEQ ID NO: 685 - protein, 49 aa, ARTIFICIAL SEQUENCE
  Engineered FcRn binding polypeptide
KENVDAAHEIRWLPNLTFDQRVAFIHKLRDDPSQSSELLSEAKKLNDSQ

SEQ ID NO: 686 - protein, 49 aa, ARTIFICIAL SEQUENCE
  Engineered FcRn binding polypeptide
KEADAASHEIRWLPNLTFDQRVAFIRKLRDDPSQSSELLSEAKKLNDSQ

SEQ ID NO: 687 - protein, 49 aa, ARTIFICIAL SEQUENCE
  Engineered FcRn binding polypeptide
KELESASHEIRWLPNLTFDQRVAFIHKLIDDPSQSSELLSEAKKLNDSQ

SEQ ID NO: 688 - protein, 49 aa, ARTIFICIAL SEQUENCE
  Engineered FcRn binding polypeptide
KEEQLAAHEIRWLPNLTFDQRVAFIRKLRDDPSQSSELLSEAKKLNDSQ

SEQ ID NO: 689 - protein, 49 aa, ARTIFICIAL SEQUENCE
  Engineered FcRn binding polypeptide
KEFELAGHEIRWLPNLTFDQRVAFIHKLDDDPSQSSELLSEAKKLNDSQ

SEQ ID NO: 690 - protein, 49 aa, ARTIFICIAL SEQUENCE
  Engineered FcRn binding polypeptide
KEAFVAQHEIRWLPNLTYDQRVAFIVKLRDDPSQSSELLSEAKKLNDSQ

SEQ ID NO: 691 - protein, 49 aa, ARTIFICIAL SEQUENCE
  Engineered FcRn binding polypeptide
KEALKASHEIRWLPNLTFDQRVAFINKLRDDPSQSSELLSEAKKLNDSQ

SEQ ID NO: 692 - protein, 49 aa, ARTIFICIAL SEQUENCE
  Engineered FcRn binding polypeptide
KELERAGHEIRWLPNLTFDQRVAFIKKLTDDPSQSSELLSEAKKLNDSQ

SEQ ID NO: 693 - protein, 49 aa, ARTIFICIAL SEQUENCE
  Engineered FcRn binding polypeptide
KEVEWAKHEIRWLPNLTFDQRVAFIHKLQDDPSQSSELLSEAKKLNDSQ

SEQ ID NO: 694 - protein, 49 aa, ARTIFICIAL SEQUENCE
  Engineered FcRn binding polypeptide
KEKASAQHEIRWLPNLTFDQRVAFIHKLDDDPSQSSELLSEAKKLNDSQ

SEQ ID NO: 695 - protein, 49 aa, ARTIFICIAL SEQUENCE
  Engineered FcRn binding polypeptide
KETEIAKHEIRWLPNLTFDQRVAFIHKLDDDPSQSSELLSEAKKLNDSQ

SEQ ID NO: 696 - protein, 49 aa, ARTIFICIAL SEQUENCE
  Engineered FcRn binding polypeptide
KEVNLAAHEIRWLPNLTFDQRVAFIHKLTDDPSQSSELLSEAKKLNDSQ

SEQ ID NO: 697 - protein, 49 aa, ARTIFICIAL SEQUENCE
  Engineered FcRn binding polypeptide
KEAEEAAHEIRWLPNLTFDQRVAFIHKLRDDPSQSSELLSEAKKLNDSQ

SEQ ID NO: 698 - protein, 49 aa, ARTIFICIAL SEQUENCE
  Engineered FcRn binding polypeptide
KETDRAKHEIRWLPNLTFDQRVAFIHKLNDDPSQSSELLSEAKKLNDSQ

SEQ ID NO: 699 - protein, 49 aa, ARTIFICIAL SEQUENCE
  Engineered FcRn binding polypeptide
KEFAQAGHEIRWLPNLTFDQRVAFIHKLKDDPSQSSELLSEAKKLNDSQ

SEQ ID NO: 700 - protein, 49 aa, ARTIFICIAL SEQUENCE
  Engineered FcRn binding polypeptide
KETDEASHEIRWLPNLTFDQRVAFIRKLRDDPSQSSELLSEAKKLNDSQ

SEQ ID NO: 701 - protein, 49 aa, ARTIFICIAL SEQUENCE
  Engineered FcRn binding polypeptide
KENADAGHEIRWLPNLTFDQRVAFIQKLRDDPSQSSELLSEAKKLNDSQ

SEQ ID NO: 702 - protein, 49 aa, ARTIFICIAL SEQUENCE
  Engineered FcRn binding polypeptide
KESTQAAHEIRWLPNLTFDQRVAFIHKLQDDPSQSSELLSEAKKLNDSQ

SEQ ID NO: 703 - protein, 49 aa, ARTIFICIAL SEQUENCE
  Engineered FcRn binding polypeptide
KEQALAAHEIRWLPNLTFDQRVAFIHKLNDDPSQSSELLSEAKKLNDSQ

SEQ ID NO: 704 - protein, 49 aa, ARTIFICIAL SEQUENCE
  Engineered FcRn binding polypeptide
KEAHAASHEIRWLPNLTFDQRVAFIHKLDDDPSQSSELLSEAKKLNDSQ

SEQ ID NO: 705 - protein, 49 aa, ARTIFICIAL SEQUENCE
  Engineered FcRn binding polypeptide
KEVDNAGHEIRWLPNLTFDQRVAFIQKLRDDPSQSSELLSEAKKLNDSQ

SEQ ID NO: 706 - protein, 49 aa, ARTIFICIAL SEQUENCE
  Engineered FcRn binding polypeptide
KEAGRAAHEIRWLPNLTWDQRVAFIWKLRDDPSQSSELLSEAKKLNDSQ

SEQ ID NO: 707 - protein, 58 aa, ARTIFICIAL SEQUENCE
  Engineered FcRn binding polypeptide
VDAKYAKEQDAAAHEIRWLPNLTFDQRVAFIHKLADDPSQSSELLSEAKKLNDSQAPK

SEQ ID NO: 708 - protein, 58 aa, ARTIFICIAL SEQUENCE
  Engineered FcRn binding polypeptide
VDAKYAKEWMRAAHEIRWLPNLTFDQRVAFIHKLEDDPSQSSELLSEAKKLNDSQAPK

SEQ ID NO: 709 - protein, 58 aa, ARTIFICIAL SEQUENCE
  Engineered FcRn binding polypeptide
VDAKYAKEANTAAHEIRWLPNLTFDQRVAFIRKLWDDPSQSSELLSEAKKLNDSQAPK

SEQ ID NO: 710 - protein, 58 aa, ARTIFICIAL SEQUENCE
  Engineered FcRn binding polypeptide
VDAKYAKEFESAAHEIRWLPNLTYDQRVAFIHKLSDDPSQSSELLSEAKKLNDSQAPK

SEQ ID NO: 711 - protein, 58 aa, ARTIFICIAL SEQUENCE
  Engineered FcRn binding polypeptide
VDAKYAKERSAAAHEIRWLPNLTFDQRVAFILKLTDDPSQSSELLSEAKKLNDSQAPK

SEQ ID NO: 712 - protein, 58 aa, ARTIFICIAL SEQUENCE
  Engineered FcRn binding polypeptide
VDAKYAKESDSAVHEIRWLPNLTFDQRVAFIHKLLDDPSQSSELLSEAKKLNDSQAPK

SEQ ID NO: 713 - protein, 58 aa, ARTIFICIAL SEQUENCE
  Engineered FcRn binding polypeptide
VDAKYAKEADNAGHEIRWLPNLTWAQRWAFIHKLLDDPSQSSELLSEAKKLNDSQAPK

SEQ ID NO: 714 - protein, 58 aa, ARTIFICIAL SEQUENCE
  Engineered FcRn binding polypeptide
VDAKYAKEDDTAAHEIRWLPNLTYEQRWAFIHKLYDDPSQSSELLSEAKKLNDSQAPK

SEQ ID NO: 715 - protein, 58 aa, ARTIFICIAL SEQUENCE
  Engineered FcRn binding polypeptide
VDAKYAKEQHDAAHEIRWLPNLTYDQRVAFIRKLHDDPSQSSELLSEAKKLNDSQAPK

SEQ ID NO: 716 - protein, 58 aa, ARTIFICIAL SEQUENCE
  Engineered FcRn binding polypeptide
VDAKYAKENQGAAHEIRWLPNLTWDQRVAFIRKLQDDPSQSSELLSEAKKLNDSQAPK

SEQ ID NO: 717 - protein, 58 aa, ARTIFICIAL SEQUENCE
  Engineered FcRn binding polypeptide
VDAKYAKERTQASHEIRWLPNLTYDQRVAFINKLRDDPSQSSELLSEAKKLNDSQAPK

SEQ ID NO: 718 - protein, 58 aa, ARTIFICIAL SEQUENCE
  Engineered FcRn binding polypeptide
VDAKYAKERKDAGHEIRWLPNLTFDQRSAFIKKLEDDPSQSSELLSEAKKLNDSQAPK

SEQ ID NO: 719 - protein, 58 aa, ARTIFICIAL SEQUENCE
  Engineered FcRn binding polypeptide
VDAKYAKERQEAAHEIRWLPNLTFDQRVAFIVKLLDDPSQSSELLSEAKKLNDSQAPK

SEQ ID NO: 720 - protein, 58 aa, ARTIFICIAL SEQUENCE
  Engineered FcRn binding polypeptide
VDAKYAKEEDVAAHEIRWLPNLTFNQRAAFIDKLLDDPSQSSELLSEAKKLNDSQAPK

SEQ ID NO: 721 - protein, 58 aa, ARTIFICIAL SEQUENCE
  Engineered FcRn binding polypeptide
VDAKYAKENQDAAHEIRWLPNLTYDQRVAFIGKLNDDPSQSSELLSEAKKLNDSQAPK

SEQ ID NO: 722 - protein, 58 aa, ARTIFICIAL SEQUENCE
  Engineered FcRn binding polypeptide
VDAKYAKESGYAVHEIRWLPNLTFDQRVAFINKLQDDPSQSSELLSEAKKLNDSQAPK

SEQ ID NO: 723 - protein, 58 aa, ARTIFICIAL SEQUENCE
  Engineered FcRn binding polypeptide
VDAKYAKESKDAAHEIRWLPNLTFDQRVAFIHKLRDDPSQSSELLSEAKKLNDSQAPK

SEQ ID NO: 724 - protein, 58 aa, ARTIFICIAL SEQUENCE
  Engineered FcRn binding polypeptide
VDAKYAKEKKEAAHEIRWLPNLTFDQRVAFIHKLRDDPSQSSELLSEAKKLNDSQAPK

SEQ ID NO: 725 - protein, 58 aa, ARTIFICIAL SEQUENCE
  Engineered FcRn binding polypeptide
VDAKYAKEWHQAAHEIRWLPNLTFDQRVAFIHKLRDDPSQSSELLSEAKKLNDSQAPK

SEQ ID NO: 726 - protein, 58 aa, ARTIFICIAL SEQUENCE
  Engineered FcRn binding polypeptide
VDAKYAKEWTDAAHEIRWLPNLTFDQRVAFIHKLRDDPSQSSELLSEAKKLNDSQAPK

SEQ ID NO: 727 - protein, 58 aa, ARTIFICIAL SEQUENCE
  Engineered FcRn binding polypeptide
VDAKYAKEISAASHEIRWLPNLTFDQRVAFIHKLRDDPSQSSELLSEAKKLNDSQAPK

SEQ ID NO: 728 - protein, 58 aa, ARTIFICIAL SEQUENCE
  Engineered FcRn binding polypeptide
VDAKYAKEQQAAAHEIRWLPNLTFDQRVAFIHKLRDDPSQSSELLSEAKKLNDSQAPK

SEQ ID NO: 729 - protein, 58 aa, ARTIFICIAL SEQUENCE
  Engineered FcRn binding polypeptide
VDAKYAKELEKAGHEIRWLPNLTFDQRVAFIHKLRDDPSQSSELLSEAKKLNDSQAPK

SEQ ID NO: 730 - protein, 58 aa, ARTIFICIAL SEQUENCE
  Engineered FcRn binding polypeptide
VDAKYAKEYLDAAHEIRWLPNLTFDQRVAFIHKLRDDPSQSSELLSEAKKLNDSQAPK

SEQ ID NO: 731 - protein, 58 aa, ARTIFICIAL SEQUENCE
  Engineered FcRn binding polypeptide
VDAKYAKELKDAGHEIRWLPNLTFDQRVAFIHKLRDDPSQSSELLSEAKKLNDSQAPK

SEQ ID NO: 732 - protein, 58 aa, ARTIFICIAL SEQUENCE
  Engineered FcRn binding polypeptide
VDAKYAKEHVDAAHEIRWLPNLTFDQRVAFIHKLRDDPSQSSELLSEAKKLNDSQAPK

SEQ ID NO: 733 - protein, 58 aa, ARTIFICIAL SEQUENCE
  Engineered FcRn binding polypeptide
VDAKYAKEYAAAAHEIRWLPNLTFDQRVAFIHKLRDDPSQSSELLSEAKKLNDSQAPK

SEQ ID NO: 734 - protein, 58 aa, ARTIFICIAL SEQUENCE
  Engineered FcRn binding polypeptide
VDAKYAKEVDIAAHEIRWLPNLTFDQRVAFIHKLRDDPSQSSELLSEAKKLNDSQAPK

SEQ ID NO: 735 - protein, 58 aa, ARTIFICIAL SEQUENCE
  Engineered FcRn binding polypeptide
VDAKYAKEIDEAKHEIRWLPNLTFDQRVAFIHKLDDDPSQSSELLSEAKKLNDSQAPK

SEQ ID NO: 736 - protein, 58 aa, ARTIFICIAL SEQUENCE
  Engineered FcRn binding polypeptide
VDAKYAKELRQAGHEIRWLPNLTFDQRVAFIHKLRDDPSQSSELLSEAKKLNDSQAPK

SEQ ID NO: 737 - protein, 58 aa, ARTIFICIAL SEQUENCE
  Engineered FcRn binding polypeptide
VDAKYAKELQSAAHEIRWLPNLTFDQRVAFIHKLKDDPSQSSELLSEAKKLNDSQAPK

SEQ ID NO: 738 - protein, 58 aa, ARTIFICIAL SEQUENCE
  Engineered FcRn binding polypeptide
VDAKYAKELEKAAHEIRWLPNLTFDQRVAFIHKLRDDPSQSSELLSEAKKLNDSQAPK

SEQ ID NO: 739 - protein, 58 aa, ARTIFICIAL SEQUENCE
  Engineered FcRn binding polypeptide
VDAKYAKEAHEAAHEIRWLPNLTFDQRVAFIHKLRDDPSQSSELLSEAKKLNDSQAPK

SEQ ID NO: 740 - protein, 58 aa, ARTIFICIAL SEQUENCE
  Engineered FcRn binding polypeptide
VDAKYAKELQAASHEIRWLPNLTFDQRVAFIHKLRDDPSQSSELLSEAKKLNDSQAPK

SEQ ID NO: 741 - protein, 58 aa, ARTIFICIAL SEQUENCE
  Engineered FcRn binding polypeptide
VDAKYAKEIESAKHEIRWLPNLTFDQRVAFIHKLNDDPSQSSELLSEAKKLNDSQAPK

SEQ ID NO: 742 - protein, 58 aa, ARTIFICIAL SEQUENCE
  Engineered FcRn binding polypeptide
VDAKYAKEWKVAAHEIRWLPNLTFDQRVAFIHKLRDDPSQSSELLSEAKKLNDSQAPK

SEQ ID NO: 743 - protein, 58 aa, ARTIFICIAL SEQUENCE
  Engineered FcRn binding polypeptide
VDAKYAKEWKAAAHEIRWLPNLTFDQRVAFIHKLRDDPSQSSELLSEAKKLNDSQAPK

SEQ ID NO: 744 - protein, 58 aa, ARTIFICIAL SEQUENCE
  Engineered FcRn binding polypeptide
VDAKYAKEIDLAKHEIRWLPNLTFDQRVAFIHKLDDDPSQSSELLSEAKKLNDSQAPK

SEQ ID NO: 745 - protein, 58 aa, ARTIFICIAL SEQUENCE
  Engineered FcRn binding polypeptide
VDAKYAKELEAARHEIRWLPNLTFDQRVAFIHKLNDDPSQSSELLSEAKKLNDSQAPK

SEQ ID NO: 746 - protein, 58 aa, ARTIFICIAL SEQUENCE
  Engineered FcRn binding polypeptide
VDAKYAKEAATAGHEIRWLPNLTFDQRVAFIHKLRDDPSQSSELLSEAKKLNDSQAPK

SEQ ID NO: 747 - protein, 58 aa, ARTIFICIAL SEQUENCE
  Engineered FcRn binding polypeptide
VDAKYAKEWQQAAHEIRWLPNLTFDQRVAFIHKLRDDPSQSSELLSEAKKLNDSQAPK

SEQ ID NO: 748 - protein, 58 aa, ARTIFICIAL SEQUENCE
  Engineered FcRn binding polypeptide
VDAKYAKEADQAGHEIRWLPNLTFDQRVAFIRKLRDDPSQSSELLSEAKKLNDSQAPK

SEQ ID NO: 749 - protein, 58 aa, ARTIFICIAL SEQUENCE
  Engineered FcRn binding polypeptide
VDAKYAKEQSKAAHEIRWLPNLTFDQRVAFIHKLRDDPSQSSELLSEAKKLNDSQAPK

SEQ ID NO: 750 - protein, 58 aa, ARTIFICIAL SEQUENCE
  Engineered FcRn binding polypeptide
VDAKYAKEADAAGHEIRWLPNLTFDQRVAFIHKLRDDPSQSSELLSEAKKLNDSQAPK

SEQ ID NO: 751 - protein, 58 aa, ARTIFICIAL SEQUENCE
  Engineered FcRn binding polypeptide
VDAKYAKEFMDAGHEIRWLPNLTFDQRVAFIHKLRDDPSQSSELLSEAKKLNDSQAPK

SEQ ID NO: 752 - protein, 58 aa, ARTIFICIAL SEQUENCE
  Engineered FcRn binding polypeptide
VDAKYAKESKQAAHEIRWLPNLTFDQRVAFIHKLRDDPSQSSELLSEAKKLNDSQAPK

SEQ ID NO: 753 - protein, 58 aa, ARTIFICIAL SEQUENCE
  Engineered FcRn binding polypeptide
VDAKYAKEVSDAAHEIRWLPNLTFDQRVAFIHKLRDDPSQSSELLSEAKKLNDSQAPK

SEQ ID NO: 754 - protein, 58 aa, ARTIFICIAL SEQUENCE
  Engineered FcRn binding polypeptide
VDAKYAKEADSASHEIRWLPNLTFDQRVAFIHKLRDDPSQSSELLSEAKKLNDSQAPK

SEQ ID NO: 755 - protein, 58 aa, ARTIFICIAL SEQUENCE
  Engineered FcRn binding polypeptide
VDAKYAKELMEAAHEIRWLPNLTFDQRVAFIHKLRDDPSQSSELLSEAKKLNDSQAPK

SEQ ID NO: 756 - protein, 58 aa, ARTIFICIAL SEQUENCE
  Engineered FcRn binding polypeptide
VDAKYAKELNTAAHEIRWLPNLTFDQRVAFIHKLKDDPSQSSELLSEAKKLNDSQAPK

SEQ ID NO: 757 - protein, 58 aa, ARTIFICIAL SEQUENCE
  Engineered FcRn binding polypeptide
VDAKYAKEVHEAGHEIRWLPNLTFDQRVAFIHKLRDDPSQSSELLSEAKKLNDSQAPK

SEQ ID NO: 758 - protein, 58 aa, ARTIFICIAL SEQUENCE
  Engineered FcRn binding polypeptide
VDAKYAKESTAAAHEIRWLPNLTFDQRVAFIHKLRDDPSQSSELLSEAKKLNDSQAPK

SEQ ID NO: 759 - protein, 58 aa, ARTIFICIAL SEQUENCE
  Engineered FcRn binding polypeptide
VDAKYAKEWYNAAHEIRWLPNLTFDQRVAFIHKLRDDPSQSSELLSEAKKLNDSQAPK

SEQ ID NO: 760 - protein, 58 aa, ARTIFICIAL SEQUENCE
  Engineered FcRn binding polypeptide
VDAKYAKEWNDAAHEIRWLPNLTFDQRVAFIHKLRDDPSQSSELLSEAKKLNDSQAPK

SEQ ID NO: 761 - protein, 58 aa, ARTIFICIAL SEQUENCE
  Engineered FcRn binding polypeptide
VDAKYAKEVEVAKHEIRWLPNLTFDQRVAFIHKLDDDPSQSSELLSEAKKLNDSQAPK

SEQ ID NO: 762 - protein, 58 aa, ARTIFICIAL SEQUENCE
  Engineered FcRn binding polypeptide
VDAKYAKEFNFAAHEIRWLPNLTFDQRVAFIHKLRDDPSQSSELLSEAKKLNDSQAPK

SEQ ID NO: 763 - protein, 58 aa, ARTIFICIAL SEQUENCE
  Engineered FcRn binding polypeptide
VDAKYAKEHDSAAHEIRWLPNLTFDQRVAFIHKLRDDPSQSSELLSEAKKLNDSQAPK

SEQ ID NO: 764 - protein, 58 aa, ARTIFICIAL SEQUENCE
  Engineered FcRn binding polypeptide
VDAKYAKEWMDAAHEIRWLPNLTFDQRVAFIHKLRDDPSQSSELLSEAKKLNDSQAPK

SEQ ID NO: 765 - protein, 58 aa, ARTIFICIAL SEQUENCE
  Engineered FcRn binding polypeptide
VDAKYAKEFSAAGHEIRWLPNLTFDQRVAFIHKLRDDPSQSSELLSEAKKLNDSQAPK

SEQ ID NO: 766 - protein, 58 aa, ARTIFICIAL SEQUENCE
  Engineered FcRn binding polypeptide
VDAKYAKELNSAAHEIRWLPNLTFDQRVAFIHKLRDDPSQSSELLSEAKKLNDSQAPK

SEQ ID NO: 767 - protein, 58 aa, ARTIFICIAL SEQUENCE
  Engineered FcRn binding polypeptide
VDAKYAKEVDTAAHEIRWLPNLTFDQRVAFIHKLRDDPSQSSELLSEAKKLNDSQAPK

SEQ ID NO: 768 - protein, 58 aa, ARTIFICIAL SEQUENCE
  Engineered FcRn binding polypeptide
VDAKYAKESQIAGHEIRWLPNLTFDQRVAFIHKLRDDPSQSSELLSEAKKLNDSQAPK

SEQ ID NO: 769 - protein, 58 aa, ARTIFICIAL SEQUENCE
  Engineered FcRn binding polypeptide
VDAKYAKEVSAASHEIRWLPNLTFDQRVAFIHKLRDDPSQSSELLSEAKKLNDSQAPK

SEQ ID NO: 770 - protein, 58 aa, ARTIFICIAL SEQUENCE
  Engineered FcRn binding polypeptide
VDAKYAKEDQDAAHEIRWLPNLTFDQRVAFIHKLRDDPSQSSELLSEAKKLNDSQAPK

SEQ ID NO: 771 - protein, 58 aa, ARTIFICIAL SEQUENCE
  Engineered FcRn binding polypeptide
VDAKYAKELEAAKHEIRWLPNLTFDQRVAFIHKLDDDPSQSSELLSEAKKLNDSQAPK

SEQ ID NO: 772 - protein, 58 aa, ARTIFICIAL SEQUENCE
  Engineered FcRn binding polypeptide
VDAKYAKESKRAAHEIRWLPNLTFDQRVAFIHKLRDDPSQSSELLSEAKKLNDSQAPK

SEQ ID NO: 773 - protein, 58 aa, ARTIFICIAL SEQUENCE
  Engineered FcRn binding polypeptide
VDAKYAKEYVKAGHEIRWLPNLTFDQRVAFIRKLRDDPSQSSELLSEAKKLNDSQAPK

SEQ ID NO: 774 - protein, 58 aa, ARTIFICIAL SEQUENCE
  Engineered FcRn binding polypeptide
VDAKYAKEFSRAGHEIRWLPNLTFDQRVAFIHKLRDDPSQSSELLSEAKKLNDSQAPK

SEQ ID NO: 775 - protein, 58 aa, ARTIFICIAL SEQUENCE
  Engineered FcRn binding polypeptide
VDAKYAKEWQFAAHEIRWLPNLTFDQRVAFIHKLRDDPSQSSELLSEAKKLNDSQAPK

SEQ ID NO: 776 - protein, 58 aa, ARTIFICIAL SEQUENCE
  Engineered FcRn binding polypeptide
VDAKYAKEWQIAAHEIRWLPNLTFDQRVAFIHKLRDDPSQSSELLSEAKKLNDSQAPK

SEQ ID NO: 777 - protein, 58 aa, ARTIFICIAL SEQUENCE
  Engineered FcRn binding polypeptide
VDAKYAKELQEAAHEIRWLPNLTFDQRVAFIHKLRDDPSQSSELLSEAKKLNDSQAPK

SEQ ID NO: 778 - protein, 58 aa, ARTIFICIAL SEQUENCE
  Engineered FcRn binding polypeptide
VDAKYAKEYRAAAHEIRWLPNLTFDQRVAFIHKLRDDPSQSSELLSEAKKLNDSQAPK

SEQ ID NO: 779 - protein, 58 aa, ARTIFICIAL SEQUENCE
  Engineered FcRn binding polypeptide
VDAKYAKELASAGHEIRWLPNLTFDQRVAFIHKLRDDPSQSSELLSEAKKLNDSQAPK

SEQ ID NO: 780 - protein, 58 aa, ARTIFICIAL SEQUENCE
  Engineered FcRn binding polypeptide
VDAKYAKEVQSASHEIRWLPNLTFDQRVAFIHKLRDDPSQSSELLSEAKKLNDSQAPK

SEQ ID NO: 781 - protein, 58 aa, ARTIFICIAL SEQUENCE
  Engineered FcRn binding polypeptide
VDAKYAKEIEDAGHEIRWLPNLTFDQRVAFIHKLRDDPSQSSELLSEAKKLNDSQAPK

SEQ ID NO: 782 - protein, 58 aa, ARTIFICIAL SEQUENCE
  Engineered FcRn binding polypeptide
VDAKYAKENQAAAHEIRWLPNLTFDQRVAFIHKLRDDPSQSSELLSEAKKLNDSQAPK

SEQ ID NO: 783 - protein, 58 aa, ARTIFICIAL SEQUENCE
  Engineered FcRn binding polypeptide
VDAKYAKEATSAGHEIRWLPNLTFDQRVAFIVKLRDDPSQSSELLSEAKKLNDSQAPK

SEQ ID NO: 784 - protein, 58 aa, ARTIFICIAL SEQUENCE
  Engineered FcRn binding polypeptide
VDAKYAKEDEQAAHEIRWLPNLTFDQRVAFIHKLRDDPSQSSELLSEAKKLNDSQAPK

SEQ ID NO: 785 - protein, 58 aa, ARTIFICIAL SEQUENCE
  Engineered FcRn binding polypeptide
VDAKYAKEQNQAGHEIRWLPNLTFDQRVAFIHKLRDDPSQSSELLSEAKKLNDSQAPK

SEQ ID NO: 786 - protein, 58 aa, ARTIFICIAL SEQUENCE
  Engineered FcRn binding polypeptide
VDAKYAKEYTSAAHEIRWLPNLTFDQRVAFIHKLRDDPSQSSELLSEAKKLNDSQAPK

SEQ ID NO: 787 - protein, 58 aa, ARTIFICIAL SEQUENCE
  Engineered FcRn binding polypeptide
VDAKYAKEWDAAAHEIRWLPNLTFDQRVAFIHKLRDDPSQSSELLSEAKKLNDSQAPK

SEQ ID NO: 788 - protein, 58 aa, ARTIFICIAL SEQUENCE
  Engineered FcRn binding polypeptide
VDAKYAKEEMQAGHEIRWLPNLTFDQRVAFIHKLRDDPSQSSELLSEAKKLNDSQAPK

SEQ ID NO: 789 - protein, 58 aa, ARTIFICIAL SEQUENCE
  Engineered FcRn binding polypeptide
VDAKYAKELSDAAHEIRWLPNLTFDQRVAFIHKLNDDPSQSSELLSEAKKLNDSQAPK

SEQ ID NO: 790 - protein, 58 aa, ARTIFICIAL SEQUENCE
  Engineered FcRn binding polypeptide
VDAKYAKEIDAAKHEIRWLPNLTFDQRVAFIHKLDDDPSQSSELLSEAKKLNDSQAPK

SEQ ID NO: 791 - protein, 58 aa, ARTIFICIAL SEQUENCE
  Engineered FcRn binding polypeptide
VDAKYAKEAERAGHEIRWLPNLTFDQRVAFIRKLRDDPSQSSELLSEAKKLNDSQAPK

SEQ ID NO: 792 - protein, 58 aa, ARTIFICIAL SEQUENCE
  Engineered FcRn binding polypeptide
VDAKYAKEEDSAAHEIRWLPNLTFDQRVAFIHKLKDDPSQSSELLSEAKKLNDSQAPK

SEQ ID NO: 793 - protein, 58 aa, ARTIFICIAL SEQUENCE
  Engineered FcRn binding polypeptide
VDAKYAKEQKAAGHEIRWLPNLTFDQRVAFIHKLRDDPSQSSELLSEAKKLNDSQAPK

SEQ ID NO: 794 - protein, 58 aa, ARTIFICIAL SEQUENCE
  Engineered FcRn binding polypeptide
VDAKYAKEWDQAAHEIRWLPNLTFDQRVAFIHKLRDDPSQSSELLSEAKKLNDSQAPK

SEQ ID NO: 795 - protein, 58 aa, ARTIFICIAL SEQUENCE
  Engineered FcRn binding polypeptide
VDAKYAKEAKAAAHEIRWLPNLTFDQRVAFIHKLRDDPSQSSELLSEAKKLNDSQAPK

SEQ ID NO: 796 - protein, 58 aa, ARTIFICIAL SEQUENCE
  Engineered FcRn binding polypeptide
VDAKYAKELSEAAHEIRWLPNLTFDQRVAFIHKLKDDPSQSSELLSEAKKLNDSQAPK

SEQ ID NO: 797 - protein, 58 aa, ARTIFICIAL SEQUENCE
  Engineered FcRn binding polypeptide
VDAKYAKETEAAKHEIRWLPNLTFDQRVAFIHKLDDDPSQSSELLSEAKKLNDSQAPK

SEQ ID NO: 798 - protein, 58 aa, ARTIFICIAL SEQUENCE
  Engineered FcRn binding polypeptide
VDAKYAKEAKSAAHEIRWLPNLTFDQRVAFIHKLRDDPSQSSELLSEAKKLNDSQAPK

SEQ ID NO: 799 - protein, 58 aa, ARTIFICIAL SEQUENCE
  Engineered FcRn binding polypeptide
VDAKYAKEQSAAAHEIRWLPNLTFDQRVAFIHKLNDDPSQSSELLSEAKKLNDSQAPK

SEQ ID NO: 800 - protein, 58 aa, ARTIFICIAL SEQUENCE
  Engineered FcRn binding polypeptide
VDAKYAKEKERAAHEIRWLPNLTFDQRVAFIHKLRDDPSQSSELLSEAKKLNDSQAPK

SEQ ID NO: 801 - protein, 58 aa, ARTIFICIAL SEQUENCE
  Engineered FcRn binding polypeptide
VDAKYAKEWDEAAHEIRWLPNLTFDQRVAFIHKLKDDPSQSSELLSEAKKLNDSQAPK

SEQ ID NO: 802 - protein, 58 aa, ARTIFICIAL SEQUENCE
  Engineered FcRn binding polypeptide
VDAKYAKEEKDAAHEIRWLPNLTFDQRVAFIHKLRDDPSQSSELLSEAKKLNDSQAPK

SEQ ID NO: 803 - protein, 58 aa, ARTIFICIAL SEQUENCE
  Engineered FcRn binding polypeptide
VDAKYAKEIENAAHEIRWLPNLTFDQRVAFIWKLRDDPSQSSELLSEAKKLNDSQAPK

SEQ ID NO: 804 - protein, 58 aa, ARTIFICIAL SEQUENCE
  Engineered FcRn binding polypeptide
VDAKYAKETKEAAHEIRWLPNLTFDQRVAFIHKLWDDPSQSSELLSEAKKLNDSQAPK

SEQ ID NO: 805 - protein, 58 aa, ARTIFICIAL SEQUENCE
  Engineered FcRn binding polypeptide
VDAKYAKELEAAKHEIRWLPNLTFDQRVAFIHKLNDDPSQSSELLSEAKKLNDSQAPK

SEQ ID NO: 806 - protein, 58 aa, ARTIFICIAL SEQUENCE
  Engineered FcRn binding polypeptide
VDAKYAKEWAEAAHEIRWLPNLTFDQRVAFIHKLRDDPSQSSELLSEAKKLNDSQAPK

SEQ ID NO: 807 - protein, 58 aa, ARTIFICIAL SEQUENCE
  Engineered FcRn binding polypeptide
VDAKYAKESQEAGHEIRWLPNLTFDQRVAFIHKLRDDPSQSSELLSEAKKLNDSQAPK

SEQ ID NO: 808 - protein, 58 aa, ARTIFICIAL SEQUENCE
  Engineered FcRn binding polypeptide
VDAKYAKELSTAAHEIRWLPNLTFDQRVAFIHKLRDDPSQSSELLSEAKKLNDSQAPK

SEQ ID NO: 809 - protein, 58 aa, ARTIFICIAL SEQUENCE
  Engineered FcRn binding polypeptide
VDAKYAKEIEEAGHEIRWLPNLTFDQRVAFIHKLRDDPSQSSELLSEAKKLNDSQAPK

SEQ ID NO: 810 - protein, 58 aa, ARTIFICIAL SEQUENCE
  Engineered FcRn binding polypeptide
VDAKYAKELQTASHEIRWLPNLTFDQRVAFIHKLRDDPSQSSELLSEAKKLNDSQAPK

SEQ ID NO: 811 - protein, 58 aa, ARTIFICIAL SEQUENCE
  Engineered FcRn binding polypeptide
VDAKYAKEQDSAAHEIRWLPNLTFDQRVAFIRKLRDDPSQSSELLSEAKKLNDSQAPK

SEQ ID NO: 812 - protein, 58 aa, ARTIFICIAL SEQUENCE
  Engineered FcRn binding polypeptide
VDAKYAKESASAGHEIRWLPNLTFDQRVAFIHKLRDDPSQSSELLSEAKKLNDSQAPK

SEQ ID NO: 813 - protein, 58 aa, ARTIFICIAL SEQUENCE
  Engineered FcRn binding polypeptide
VDAKYAKEVAKASHEIRWLPNLTFDQRVAFIHKLRDDPSQSSELLSEAKKLNDSQAPK

SEQ ID NO: 814 - protein, 58 aa, ARTIFICIAL SEQUENCE
  Engineered FcRn binding polypeptide
VDAKYAKEVQEAAHEIRWLPNLTFDQRVAFIHKLWDDPSQSSELLSEAKKLNDSQAPK

SEQ ID NO: 815 - protein, 58 aa, ARTIFICIAL SEQUENCE
  Engineered FcRn binding polypeptide
VDAKYAKESYEAAHEIRWLPNLTFDQRVAFIHKLRDDPSQSSELLSEAKKLNDSQAPK

SEQ ID NO: 816 - protein, 58 aa, ARTIFICIAL SEQUENCE
  Engineered FcRn binding polypeptide
VDAKYAKETAEAGHEIRWLPNLTFDQRVAFIHKLRDDPSQSSELLSEAKKLNDSQAPK

SEQ ID NO: 817 - protein, 58 aa, ARTIFICIAL SEQUENCE
  Engineered FcRn binding polypeptide
VDAKYAKELEEAAHEIRWLPNLTFDQRVAFIHKLRDDPSQSSELLSEAKKLNDSQAPK

SEQ ID NO: 818 - protein, 58 aa, ARTIFICIAL SEQUENCE
  Engineered FcRn binding polypeptide
VDAKYAKEAAAAGHEIRWLPNLTFDQRVAFIHKLRDDPSQSSELLSEAKKLNDSQAPK

SEQ ID NO: 819 - protein, 58 aa, ARTIFICIAL SEQUENCE
  Engineered FcRn binding polypeptide
VDAKYAKEYVDAGHEIRWLPNLTFDQRVAFIRKLRDDPSQSSELLSEAKKLNDSQAPK

SEQ ID NO: 820 - protein, 58 aa, ARTIFICIAL SEQUENCE
  Engineered FcRn binding polypeptide
VDAKYAKEIQEAGHEIRWLPNLTFDQRVAFIHKLRDDPSQSSELLSEAKKLNDSQAPK

SEQ ID NO: 821 - protein, 58 aa, ARTIFICIAL SEQUENCE
  Engineered FcRn binding polypeptide
VDAKYAKESATAAHEIRWLPNLTFDQRVAFIHKLRDDPSQSSELLSEAKKLNDSQAPK

SEQ ID NO: 822 - protein, 58 aa, ARTIFICIAL SEQUENCE
  Engineered FcRn binding polypeptide
VDAKYAKEWMSAAHEIRWLPNLTFDQRVAFIHKLRDDPSQSSELLSEAKKLNDSQAPK

SEQ ID NO: 823 - protein, 58 aa, ARTIFICIAL SEQUENCE
  Engineered FcRn binding polypeptide
VDAKYAKEREQASHEIRWLPNLTFDQRVAFIHKLRDDPSQSSELLSEAKKLNDSQAPK

SEQ ID NO: 824 - protein, 58 aa, ARTIFICIAL SEQUENCE
  Engineered FcRn binding polypeptide
VDAKYAKEIEQAGHEIRWLPNLTFDQRVAFIHKLRDDPSQSSELLSEAKKLNDSQAPK

SEQ ID NO: 825 - protein, 58 aa, ARTIFICIAL SEQUENCE
  Engineered FcRn binding polypeptide
VDAKYAKEHNAAAHEIRWLPNLTFDQRVAFIHKLRDDPSQSSELLSEAKKLNDSQAPK

SEQ ID NO: 826 - protein, 58 aa, ARTIFICIAL SEQUENCE
  Engineered FcRn binding polypeptide
VDAKYAKEIEVAAHEIRWLPNLTFDQRVAFIHKLRDDPSQSSELLSEAKKLNDSQAPK

SEQ ID NO: 827 - protein, 58 aa, ARTIFICIAL SEQUENCE
  Engineered FcRn binding polypeptide
VDAKYAKERAEAAHEIRWLPNLTFDQRVAFIHKLRDDPSQSSELLSEAKKLNDSQAPK

SEQ ID NO: 828 - protein, 58 aa, ARTIFICIAL SEQUENCE
  Engineered FcRn binding polypeptide
VDAKYAKESELAAHEIRWLPNLTFDQRVAFIWKLRDDPSQSSELLSEAKKLNDSQAPK

SEQ ID NO: 829 - protein, 58 aa, ARTIFICIAL SEQUENCE
  Engineered FcRn binding polypeptide
VDAKYAKEYRAAGHEIRWLPNLTFDQRVAFIHKLRDDPSQSSELLSEAKKLNDSQAPK

SEQ ID NO: 830 - protein, 58 aa, ARTIFICIAL SEQUENCE
  Engineered FcRn binding polypeptide
VDAKYAKETANAAHEIRWLPNLTFDQRVAFIHKLRDDPSQSSELLSEAKKLNDSQAPK

SEQ ID NO: 831 - protein, 58 aa, ARTIFICIAL SEQUENCE
  Engineered FcRn binding polypeptide
VDAKYAKEWYEAAHEIRWLPNLTFDQRVAFIHKLRDDPSQSSELLSEAKKLNDSQAPK

SEQ ID NO: 832 - protein, 58 aa, ARTIFICIAL SEQUENCE
  Engineered FcRn binding polypeptide
VDAKYAKEEQEAAHEIRWLPNLTFDQRVAFIHKLWDDPSQSSELLSEAKKLNDSQAPK

SEQ ID NO: 833 - protein, 58 aa, ARTIFICIAL SEQUENCE
  Engineered FcRn binding polypeptide
VDAKYAKEHDDAAHEIRWLPNLTFDQRVAFIHKLRDDPSQSSELLSEAKKLNDSQAPK

SEQ ID NO: 834 - protein, 58 aa, ARTIFICIAL SEQUENCE
  Engineered FcRn binding polypeptide
VDAKYAKEWYSAAHEIRWLPNLTFDQRVAFIHKLRDDPSQSSELLSEAKKLNDSQAPK

SEQ ID NO: 835 - protein, 58 aa, ARTIFICIAL SEQUENCE
  Engineered FcRn binding polypeptide
VDAKYAKEISDAAHEIRWLPNLTFDQRVAFIHKLRDDPSQSSELLSEAKKLNDSQAPK

SEQ ID NO: 836 - protein, 58 aa, ARTIFICIAL SEQUENCE
  Engineered FcRn binding polypeptide
VDAKYAKEYTTAAHEIRWLPNLTFDQRVAFIHKLRDDPSQSSELLSEAKKLNDSQAPK

SEQ ID NO: 837 - protein, 58 aa, ARTIFICIAL SEQUENCE
  Engineered FcRn binding polypeptide
VDAKYAKEISQAAHEIRWLPNLTFDQRVAFIHKLRDDPSQSSELLSEAKKLNDSQAPK

SEQ ID NO: 838 - protein, 58 aa, ARTIFICIAL SEQUENCE
  Engineered FcRn binding polypeptide
VDAKYAKENDDAAHEIRWLPNLTFDQRVAFIHKLRDDPSQSSELLSEAKKLNDSQAPK

SEQ ID NO: 839 - protein, 58 aa, ARTIFICIAL SEQUENCE
  Engineered FcRn binding polypeptide
VDAKYAKESEIAGHEIRWLPNLTFDQRVAFIRKLRDDPSQSSELLSEAKKLNDSQAPK

SEQ ID NO: 840 - protein, 58 aa, ARTIFICIAL SEQUENCE
  Engineered FcRn binding polypeptide
VDAKYAKEQADAAHEIRWLPNLTFDQRVAFIHKLRDDPSQSSELLSEAKKLNDSQAPK

SEQ ID NO: 841 - protein, 58 aa, ARTIFICIAL SEQUENCE
  Engineered FcRn binding polypeptide
VDAKYAKETESAAHEIRWLPNLTFDQRVAFIHKLRDDPSQSSELLSEAKKLNDSQAPK

SEQ ID NO: 842 - protein, 58 aa, ARTIFICIAL SEQUENCE
  Engineered FcRn binding polypeptide
VDAKYAKEISDAKHEIRWLPNLTFDQRVAFIHKLDDDPSQSSELLSEAKKLNDSQAPK

SEQ ID NO: 843 - protein, 58 aa, ARTIFICIAL SEQUENCE
  Engineered FcRn binding polypeptide
VDAKYAKEHLNAAHEIRWLPNLTFDQRVAFIHKLRDDPSQSSELLSEAKKLNDSQAPK

SEQ ID NO: 844 - protein, 58 aa, ARTIFICIAL SEQUENCE
  Engineered FcRn binding polypeptide
VDAKYAKEWLDAAHEIRWLPNLTFDQRVAFIHKLRDDPSQSSELLSEAKKLNDSQAPK

SEQ ID NO: 845 - protein, 58 aa, ARTIFICIAL SEQUENCE
  Engineered FcRn binding polypeptide
VDAKYAKENAAAAHEIRWLPNLTFDQRVAFIHKLRDDPSQSSELLSEAKKLNDSQAPK

SEQ ID NO: 846 - protein, 58 aa, ARTIFICIAL SEQUENCE
  Engineered FcRn binding polypeptide
VDAKYAKEAELAGHEIRWLPNLTFDQRVAFIRKLRDDPSQSSELLSEAKKLNDSQAPK

SEQ ID NO: 847 - protein, 58 aa, ARTIFICIAL SEQUENCE
  Engineered FcRn binding polypeptide
VDAKYAKEVTDAGHEIRWLPNLTFDQRVAFIEKLKDDPSQSSELLSEAKKLNDSQAPK

SEQ ID NO: 848 - protein, 58 aa, ARTIFICIAL SEQUENCE
  Engineered FcRn binding polypeptide
VDAKYAKELDSASHEIRWLPNLTFDQRVAFINKLLDDPSQSSELLSEAKKLNDSQAPK

SEQ ID NO: 849 - protein, 58 aa, ARTIFICIAL SEQUENCE
  Engineered FcRn binding polypeptide
VDAKYAKEINLAKHEIRWLPNLTFDQRVAFIEKLNDDPSQSSELLSEAKKLNDSQAPK

SEQ ID NO: 850 - protein, 58 aa, ARTIFICIAL SEQUENCE
  Engineered FcRn binding polypeptide
VDAKYAKESEVAKHEIRWLPNLTFDQRVAFIHKLSDDPSQSSELLSEAKKLNDSQAPK

SEQ ID NO: 851 - protein, 58 aa, ARTIFICIAL SEQUENCE
  Engineered FcRn binding polypeptide
VDAKYAKESAEAGHEIRWLPNLTFDQRVAFIHKLQDDPSQSSELLSEAKKLNDSQAPK

SEQ ID NO: 852 - protein, 58 aa, ARTIFICIAL SEQUENCE
  Engineered FcRn binding polypeptide
VDAKYAKEYSNAAHEIRWLPNLTFDQRVAFIDKLSDDPSQSSELLSEAKKLNDSQAPK

SEQ ID NO: 853 - protein, 58 aa, ARTIFICIAL SEQUENCE
  Engineered FcRn binding polypeptide
VDAKYAKETNNAGHEIRWLPNLTFDQRVAFIIKLRDDPSQSSELLSEAKKLNDSQAPK

SEQ ID NO: 854 - protein, 58 aa, ARTIFICIAL SEQUENCE
  Engineered FcRn binding polypeptide
VDAKYAKEVEFAAHEIRWLPNLTFDQRVAFIHKLNDDPSQSSELLSEAKKLNDSQAPK

SEQ ID NO: 855 - protein, 58 aa, ARTIFICIAL SEQUENCE
  Engineered FcRn binding polypeptide
VDAKYAKEVELAGHEIRWLPNLTFDQRVAFIEKLHDDPSQSSELLSEAKKLNDSQAPK

SEQ ID NO: 856 - protein, 58 aa, ARTIFICIAL SEQUENCE
  Engineered FcRn binding polypeptide
VDAKYAKEVLKASHEIRWLPNLTFDQRVAFITKLQDDPSQSSELLSEAKKLNDSQAPK

SEQ ID NO: 857 - protein, 58 aa, ARTIFICIAL SEQUENCE
  Engineered FcRn binding polypeptide
VDAKYAKEIANAGHEIRWLPNLTFDQRVAFIRKLDDDPSQSSELLSEAKKLNDSQAPK

SEQ ID NO: 858 - protein, 58 aa, ARTIFICIAL SEQUENCE
  Engineered FcRn binding polypeptide
VDAKYAKEYMKAGHEIRWLPNLTFDQRVAFIVKLRDDPSQSSELLSEAKKLNDSQAPK

SEQ ID NO: 859 - protein, 58 aa, ARTIFICIAL SEQUENCE
  Engineered FcRn binding polypeptide
VDAKYAKEHANAQHEIRWLPNLTFDQRVAFIHKLQDDPSQSSELLSEAKKLNDSQAPK

SEQ ID NO: 860 - protein, 58 aa, ARTIFICIAL SEQUENCE
  Engineered FcRn binding polypeptide
VDAKYAKEVDIASHEIRWLPNLTYDQRVAFIWKLRDDPSQSSELLSEAKKLNDSQAPK

SEQ ID NO: 861 - protein, 58 aa, ARTIFICIAL SEQUENCE
  Engineered FcRn binding polypeptide
VDAKYAKEEVFAAHEIRWLPNLTYDQRVAFIVKLRDDPSQSSELLSEAKKLNDSQAPK

SEQ ID NO: 862 - protein, 58 aa, ARTIFICIAL SEQUENCE
  Engineered FcRn binding polypeptide
VDAKYAKEFNTAAHEIRWLPNLTFDQRVAFINKLDDDPSQSSELLSEAKKLNDSQAPK

SEQ ID NO: 863 - protein, 58 aa, ARTIFICIAL SEQUENCE
  Engineered FcRn binding polypeptide
VDAKYAKEVDVAGHEIRWLPNLTFDQRVAFIRKLNDDPSQSSELLSEAKKLNDSQAPK

SEQ ID NO: 864 - protein, 58 aa, ARTIFICIAL SEQUENCE
  Engineered FcRn binding polypeptide
VDAKYAKEWSLAAHEIRWLPNLTFDQRVAFIVKLRDDPSQSSELLSEAKKLNDSQAPK

SEQ ID NO: 865 - protein, 58 aa, ARTIFICIAL SEQUENCE
  Engineered FcRn binding polypeptide
VDAKYAKELDDAAHEIRWLPNLTFDQRVAFIQKLQDDPSQSSELLSEAKKLNDSQAPK

SEQ ID NO: 866 - protein, 58 aa, ARTIFICIAL SEQUENCE
  Engineered FcRn binding polypeptide
VDAKYAKERHEAGHEIRWLPNLTFDQRVAFIRKLNDDPSQSSELLSEAKKLNDSQAPK

SEQ ID NO: 867 - protein, 58 aa, ARTIFICIAL SEQUENCE
  Engineered FcRn binding polypeptide
VDAKYAKEISDAIHEIRWLPNLTFDQRVAFIHKLQDDPSQSSELLSEAKKLNDSQAPK

SEQ ID NO: 868 - protein, 58 aa, ARTIFICIAL SEQUENCE
  Engineered FcRn binding polypeptide
VDAKYAKEWETAGHEIRWLPNLTFDQRVAFIVKLSDDPSQSSELLSEAKKLNDSQAPK

SEQ ID NO: 869 - protein, 58 aa, ARTIFICIAL SEQUENCE
  Engineered FcRn binding polypeptide
VDAKYAKERYWASHEIRWLPNLTFDQRVAFIHKLNDDPSQSSELLSEAKKLNDSQAPK

SEQ ID NO: 870 - protein, 58 aa, ARTIFICIAL SEQUENCE
  Engineered FcRn binding polypeptide
VDAKYAKEIDWAGHEIRWLPNLTFDQRVAFIHKLLDDPSQSSELLSEAKKLNDSQAPK

SEQ ID NO: 871 - protein, 58 aa, ARTIFICIAL SEQUENCE
  Engineered FcRn binding polypeptide
VDAKYAKEQSKAGHEIRWLPNLTFDQRVAFIHKLKDDPSQSSELLSEAKKLNDSQAPK

SEQ ID NO: 872 - protein, 58 aa, ARTIFICIAL SEQUENCE
  Engineered FcRn binding polypeptide
VDAKYAKEIEAAQHEIRWLPNLTFDQRVAFINKLRDDPSQSSELLSEAKKLNDSQAPK

SEQ ID NO: 873 - protein, 58 aa, ARTIFICIAL SEQUENCE
  Engineered FcRn binding polypeptide
VDAKYAKEHEQAAHEIRWLPNLTFDQRVAFIRKLVDDPSQSSELLSEAKKLNDSQAPK

SEQ ID NO: 874 - protein, 58 aa, ARTIFICIAL SEQUENCE
  Engineered FcRn binding polypeptide
VDAKYAKEAEQAGHEIRWLPNLTFDQRVAFINKLQDDPSQSSELLSEAKKLNDSQAPK

SEQ ID NO: 875 - protein, 58 aa, ARTIFICIAL SEQUENCE
  Engineered FcRn binding polypeptide
VDAKYAKEVDYAAHEIRWLPNLTFDQRVAFIHKLWDDPSQSSELLSEAKKLNDSQAPK

SEQ ID NO: 876 - protein, 58 aa, ARTIFICIAL SEQUENCE
  Engineered FcRn binding polypeptide
VDAKYAKEYSAAGHEIRWLPNLTFDQRVAFIEKLRDDPSQSSELLSEAKKLNDSQAPK

SEQ ID NO: 877 - protein, 58 aa, ARTIFICIAL SEQUENCE
  Engineered FcRn binding polypeptide
VDAKYAKELATASHEIRWLPNLTFDQRVAFIHKLRDDPSQSSELLSEAKKLNDSQAPK

SEQ ID NO: 878 - protein, 58 aa, ARTIFICIAL SEQUENCE
  Engineered FcRn binding polypeptide
VDAKYAKEYRVAGHEIRWLPNLTFDQRVAFIQKLRDDPSQSSELLSEAKKLNDSQAPK

SEQ ID NO: 879 - protein, 58 aa, ARTIFICIAL SEQUENCE
  Engineered FcRn binding polypeptide
VDAKYAKEVVSAKHEIRWLPNLTFDQRVAFIHKLDDDPSQSSELLSEAKKLNDSQAPK

SEQ ID NO: 880 - protein, 58 aa, ARTIFICIAL SEQUENCE
  Engineered FcRn binding polypeptide
VDAKYAKESAQAAHEIRWLPNLTFDQRVAFIRKLRDDPSQSSELLSEAKKLNDSQAPK

SEQ ID NO: 881 - protein, 58 aa, ARTIFICIAL SEQUENCE
  Engineered FcRn binding polypeptide
VDAKYAKEYSAAGHEIRWLPNLTFDQRVAFIHKLRDDPSQSSELLSEAKKLNDSQAPK

SEQ ID NO: 882 - protein, 58 aa, ARTIFICIAL SEQUENCE
  Engineered FcRn binding polypeptide
VDAKYAKEQKEAAAEIRWLPNLTFDQRVAFIHKLRDDPSQSSELLSEAKKLNDSQAPK

SEQ ID NO: 883 - protein, 58 aa, ARTIFICIAL SEQUENCE
  Engineered FcRn binding polypeptide
VDAKYAKEAAIAGKEIRWLPNLTFDQRVAFIHKLRDDPSQSSELLSEAKKLNDSQAPK

SEQ ID NO: 884 - protein, 58 aa, ARTIFICIAL SEQUENCE
  Engineered FcRn binding polypeptide
VDAKYAKEISKAKHEIRWLPNLTFDQRVAFIHKLDDDPSQSSELLSEAKKLNDSQAPK

SEQ ID NO: 885 - protein, 58 aa, ARTIFICIAL SEQUENCE
  Engineered FcRn binding polypeptide
VDAKYAKESVAAAHEIRWLPNLTFDQRVAFIWKLRDDPSQSSELLSEAKKLNDSQAPK

SEQ ID NO: 886 - protein, 58 aa, ARTIFICIAL SEQUENCE
  Engineered FcRn binding polypeptide
VDAKYAKEIQQAKHEIRWLPNLTFDQRVAFIHKLDDDPSQSSELLSEAKKLNDSQAPK

SEQ ID NO: 887 - protein, 58 aa, ARTIFICIAL SEQUENCE
  Engineered FcRn binding polypeptide
VDAKYAKEITSAKHEIRWLPNLTFDQRVAFIHKLDDDPSQSSELLSEAKKLNDSQAPK

SEQ ID NO: 888 - protein, 58 aa, ARTIFICIAL SEQUENCE
  Engineered FcRn binding polypeptide
VDAKYAKEQDVAAHEIRWLPNLTFDQRVAFIRKLRDDPSQSSELLSEAKKLNDSQAPK

SEQ ID NO: 889 - protein, 58 aa, ARTIFICIAL SEQUENCE
  Engineered FcRn binding polypeptide
VDAKYAKELERAAHEIRWLPNLTFDQRVAFINKLKDDPSQSSELLSEAKKLNDSQAPK

SEQ ID NO: 890 - protein, 58 aa, ARTIFICIAL SEQUENCE
  Engineered FcRn binding polypeptide
VDAKYAKENQLAAHEIRWLPNLTFDQRVAFIHKLRDDPSQSSELLSEAKKLNDSQAPK

SEQ ID NO: 891 - protein, 58 aa, ARTIFICIAL SEQUENCE
  Engineered FcRn binding polypeptide
VDAKYAKEISQAKHEIRWLPNLTFDQRVAFIHKLDDDPSQSSELLSEAKKLNDSQAPK

SEQ ID NO: 892 - protein, 58 aa, ARTIFICIAL SEQUENCE
  Engineered FcRn binding polypeptide
VDAKYAKEIANASHEIRWLPNLTFDQRVAFIYKLRDDPSQSSELLSEAKKLNDSQAPK

SEQ ID NO: 893 - protein, 58 aa, ARTIFICIAL SEQUENCE
  Engineered FcRn binding polypeptide
VDAKYAKEWQAAAHEIRWLPNLTFDQRVAFIRKLRDDPSQSSELLSEAKKLNDSQAPK

SEQ ID NO: 894 - protein, 58 aa, ARTIFICIAL SEQUENCE
  Engineered FcRn binding polypeptide
VDAKYAKERKDAGHEIRWLPNLTFDQRVAFIRKLRDDPSQSSELLSEAKKLNDSQAPK

SEQ ID NO: 895 - protein, 58 aa, ARTIFICIAL SEQUENCE
  Engineered FcRn binding polypeptide
VDAKYAKEITQAKHEIRWLPNLTFDQRVAFIHKLDDDPSQSSELLSEAKKLNDSQAPK

SEQ ID NO: 896 - protein, 58 aa, ARTIFICIAL SEQUENCE
  Engineered FcRn binding polypeptide
VDAKYAKEFIQAGHEIRWLPNLTFDQRVAFIHKLRDDPSQSSELLSEAKKLNDSQAPK

SEQ ID NO: 897 - protein, 58 aa, ARTIFICIAL SEQUENCE
  Engineered FcRn binding polypeptide
VDAKYAKEWNTASHEIRWLPNLTFDQRVAFIHKLRDDPSQSSELLSEAKKLNDSQAPK

SEQ ID NO: 898 - protein, 58 aa, ARTIFICIAL SEQUENCE
  Engineered FcRn binding polypeptide
VDAKYAKEKFVAAHEIRWLPNLTFDQRVAFIHKLKDDPSQSSELLSEAKKLNDSQAPK

SEQ ID NO: 899 - protein, 58 aa, ARTIFICIAL SEQUENCE
  Engineered FcRn binding polypeptide
VDAKYAKEADSAGAEIRWLPNLTFDQRVAFIHKLRDDPSQSSELLSEAKKLNDSQAPK

SEQ ID NO: 900 - protein, 58 aa, ARTIFICIAL SEQUENCE
  Engineered FcRn binding polypeptide
VDAKYAKESSVAAAEIRWLPNLTFDQRVAFIHKLRDDPSQSSELLSEAKKLNDSQAPK

SEQ ID NO: 901 - protein, 58 aa, ARTIFICIAL SEQUENCE
  Engineered FcRn binding polypeptide
VDAKYAKEVDLAGREIRWLPNLTFDQRVAFIHKLRDDPSQSSELLSEAKKLNDSQAPK

SEQ ID NO: 902 - protein, 58 aa, ARTIFICIAL SEQUENCE
  Engineered FcRn binding polypeptide
VDAKYAKEQERAAAEIRWLPNLTFDQRVAFIHKLRDDPSQSSELLSEAKKLNDSQAPK

SEQ ID NO: 903 - protein, 58 aa, ARTIFICIAL SEQUENCE
  Engineered FcRn binding polypeptide
VDAKYAKEIWQAKHEIRWLPNLTFDQRVAFIHKLDDDPSQSSELLSEAKKLNDSQAPK

SEQ ID NO: 904 - protein, 58 aa, ARTIFICIAL SEQUENCE
  Engineered FcRn binding polypeptide
VDAKYAKELNQAKHEIRWLPNLTFDQRVAFIHKLEDDPSQSSELLSEAKKLNDSQAPK

SEQ ID NO: 905 - protein, 58 aa, ARTIFICIAL SEQUENCE
  Engineered FcRn binding polypeptide
VDAKYAKELQQASHEIRWLPNLTFDQRVAFIHKLRDDPSQSSELLSEAKKLNDSQAPK

SEQ ID NO: 906 - protein, 58 aa, ARTIFICIAL SEQUENCE
  Engineered FcRn binding polypeptide
VDAKYAKEINQAKHEIRWLPNLTFDQRVAFIHKLDDDPSQSSELLSEAKKLNDSQAPK

SEQ ID NO: 907 - protein, 58 aa, ARTIFICIAL SEQUENCE
  Engineered FcRn binding polypeptide
VDAKYAKELVLAGHEIRWLPNLTFDQRVAFIHKLRDDPSQSSELLSEAKKLNDSQAPK

SEQ ID NO: 908 - protein, 58 aa, ARTIFICIAL SEQUENCE
  Engineered FcRn binding polypeptide
VDAKYAKELTSAAHEIRWLPNLTFDQRVAFIHKLRDDPSQSSELLSEAKKLNDSQAPK

SEQ ID NO: 909 - protein, 58 aa, ARTIFICIAL SEQUENCE
  Engineered FcRn binding polypeptide
VDAKYAKEWNAAAREIRWLPNLTFDQRVAFIHKLRDDPSQSSELLSEAKKLNDSQAPK

SEQ ID NO: 910 - protein, 58 aa, ARTIFICIAL SEQUENCE
  Engineered FcRn binding polypeptide
VDAKYAKEILHAKHEIRWLPNLTFDQRVAFIHKLDDDPSQSSELLSEAKKLNDSQAPK

SEQ ID NO: 911 - protein, 58 aa, ARTIFICIAL SEQUENCE
  Engineered FcRn binding polypeptide
VDAKYAKEVLTAKHEIRWLPNLTFDQRVAFIHKLNDDPSQSSELLSEAKKLNDSQAPK

SEQ ID NO: 912 - protein, 58 aa, ARTIFICIAL SEQUENCE
  Engineered FcRn binding polypeptide
VDAKYAKENSKAAHEIRWLPNLTFDQRVAFIHKLADDPSQSSELLSEAKKLNDSQAPK

SEQ ID NO: 913 - protein, 58 aa, ARTIFICIAL SEQUENCE
  Engineered FcRn binding polypeptide
VDAKYAKEVMTAKHEIRWLPNLTFDQRVAFIHKLDDDPSQSSELLSEAKKLNDSQAPK

SEQ ID NO: 914 - protein, 58 aa, ARTIFICIAL SEQUENCE
  Engineered FcRn binding polypeptide
VDAKYAKEARDAAHEIRWLPNLTFDQRVAFIHKLSDDPSQSSELLSEAKKLNDSQAPK

SEQ ID NO: 915 - protein, 58 aa, ARTIFICIAL SEQUENCE
  Engineered FcRn binding polypeptide
VDAKYAKERSKAAHEIRWLPNLTFDQRVAFIHKLKDDPSQSSELLSEAKKLNDSQAPK

SEQ ID NO: 916 - protein, 58 aa, ARTIFICIAL SEQUENCE
  Engineered FcRn binding polypeptide
VDAKYAKEIYSAKHEIRWLPNLTFDQRVAFIHKLDDDPSQSSELLSEAKKLNDSQAPK

SEQ ID NO: 917 - protein, 58 aa, ARTIFICIAL SEQUENCE
  Engineered FcRn binding polypeptide
VDAKYAKEVQSAKHEIRWLPNLTFDQRVAFIHKLDDDPSQSSELLSEAKKLNDSQAPK

SEQ ID NO: 918 - protein, 58 aa, ARTIFICIAL SEQUENCE
  Engineered FcRn binding polypeptide
VDAKYAKETLEAAHEIRWLPNLTFDQRVAFIHKLKDDPSQSSELLSEAKKLNDSQAPK

SEQ ID NO: 919 - protein, 58 aa, ARTIFICIAL SEQUENCE
  Engineered FcRn binding polypeptide
VDAKYAKEQMRAAHEIRWLPNLTFDQRVAFIRKLRDDPSQSSELLSEAKKLNDSQAPK

SEQ ID NO: 920 - protein, 58 aa, ARTIFICIAL SEQUENCE
  Engineered FcRn binding polypeptide
VDAKYAKENKNAAHEIRWLPNLTFDQRVAFIHKLRDDPSQSSELLSEAKKLNDSQAPK

SEQ ID NO: 921 - protein, 58 aa, ARTIFICIAL SEQUENCE
  Engineered FcRn binding polypeptide
VDAKYAKETESAKHEIRWLPNLTFDQRVAFIHKLTDDPSQSSELLSEAKKLNDSQAPK

SEQ ID NO: 922 - protein, 58 aa, ARTIFICIAL SEQUENCE
  Engineered FcRn binding polypeptide
VDAKYAKETVQAKHEIRWLPNLTFDQRVAFIHKLDDDPSQSSELLSEAKKLNDSQAPK

SEQ ID NO: 923 - protein, 58 aa, ARTIFICIAL SEQUENCE
  Engineered FcRn binding polypeptide
VDAKYAKEIASAKHEIRWLPNLTFDQRVAFIHKLDDDPSQSSELLSEAKKLNDSQAPK

SEQ ID NO: 924 - protein, 58 aa, ARTIFICIAL SEQUENCE
  Engineered FcRn binding polypeptide
VDAKYAKEVMDAKHEIRWLPNLTFDQRVAFIHKLDDDPSQSSELLSEAKKLNDSQAPK

SEQ ID NO: 925 - protein, 58 aa, ARTIFICIAL SEQUENCE
  Engineered FcRn binding polypeptide
VDAKYAKETDAAKHEIRWLPNLTFDQRVAFIHKLRDDPSQSSELLSEAKKLNDSQAPK

SEQ ID NO: 926 - protein, 58 aa, ARTIFICIAL SEQUENCE
  Engineered FcRn binding polypeptide
VDAKYAKELQIAKHEIRWLPNLTFDQRVAFIHKLDDDPSQSSELLSEAKKLNDSQAPK

SEQ ID NO: 927 - protein, 58 aa, ARTIFICIAL SEQUENCE
  Engineered FcRn binding polypeptide
VDAKYAKEWKDAAQEIRWLPNLTFDQRVAFIHKLRDDPSQSSELLSEAKKLNDSQAPK

SEQ ID NO: 928 - protein, 58 aa, ARTIFICIAL SEQUENCE
  Engineered FcRn binding polypeptide
VDAKYAKERDSAAHEIRWLPNLTFDQRVAFIRKLRDDPSQSSELLSEAKKLNDSQAPK

SEQ ID NO: 929 - protein, 58 aa, ARTIFICIAL SEQUENCE
  Engineered FcRn binding polypeptide
VDAKYAKEIAAAKHEIRWLPNLTFDQRVAFIHKLDDDPSQSSELLSEAKKLNDSQAPK

SEQ ID NO: 930 - protein, 58 aa, ARTIFICIAL SEQUENCE
  Engineered FcRn binding polypeptide
VDAKYAKESVKAKHEIRWLPNLTFDQRVAFIHKLDDDPSQSSELLSEAKKLNDSQAPK

SEQ ID NO: 931 - protein, 58 aa, ARTIFICIAL SEQUENCE
  Engineered FcRn binding polypeptide
VDAKYAKENERAKHEIRWLPNLTFDQRVAFIHKLDDDPSQSSELLSEAKKLNDSQAPK

SEQ ID NO: 932 - protein, 58 aa, ARTIFICIAL SEQUENCE
  Engineered FcRn binding polypeptide
VDAKYAKEYKRAGHEIRWLPNLTFDQRVAFIRKLRDDPSQSSELLSEAKKLNDSQAPK

SEQ ID NO: 933 - protein, 58 aa, ARTIFICIAL SEQUENCE
  Engineered FcRn binding polypeptide
VDAKYAKEVRAASHEIRWLPNLTFDQRVAFIHKLRDDPSQSSELLSEAKKLNDSQAPK

SEQ ID NO: 934 - protein, 58 aa, ARTIFICIAL SEQUENCE
  Engineered FcRn binding polypeptide
VDAKYAKEDKRAAHEIRWLPNLTFDQRVAFIRKLRDDPSQSSELLSEAKKLNDSQAPK

SEQ ID NO: 935 - protein, 58 aa, ARTIFICIAL SEQUENCE
  Engineered FcRn binding polypeptide
VDAKYAKESEKAGKEIRWLPNLTFDQRVAFIRKLRDDPSQSSELLSEAKKLNDSQAPK

SEQ ID NO: 936 - protein, 58 aa, ARTIFICIAL SEQUENCE
  Engineered FcRn binding polypeptide
VDAKYAKEINRAKHEIRWLPNLTFDQRVAFIHKLDDDPSQSSELLSEAKKLNDSQAPK

SEQ ID NO: 937 - protein, 58 aa, ARTIFICIAL SEQUENCE
  Engineered FcRn binding polypeptide
VDAKYAKETQQASHEIRWLPNLTFDQRVAFIHKLRDDPSQSSELLSEAKKLNDSQAPK

SEQ ID NO: 938 - protein, 58 aa, ARTIFICIAL SEQUENCE
  Engineered FcRn binding polypeptide
VDAKYAKENQSAAHEIRWLPNLTFDQRVAFIRKLRDDPSQSSELLSEAKKLNDSQAPK

SEQ ID NO: 939 - protein, 58 aa, ARTIFICIAL SEQUENCE
  Engineered FcRn binding polypeptide
VDAKYAKEAKQASHEIRWLPNLTFDQRVAFIVKLRDDPSQSSELLSEAKKLNDSQAPK

SEQ ID NO: 940 - protein, 58 aa, ARTIFICIAL SEQUENCE
  Engineered FcRn binding polypeptide
VDAKYAKEAAQAAHEIRWLPNLTFDQRVAFIHKLRDDPSQSSELLSEAKKLNDSQAPK

SEQ ID NO: 941 - protein, 58 aa, ARTIFICIAL SEQUENCE
  Engineered FcRn binding polypeptide
VDAKYAKEVQYASHEIRWLPNLTFDQRVAFIHKLRDDPSQSSELLSEAKKLNDSQAPK

SEQ ID NO: 942 - protein, 58 aa, ARTIFICIAL SEQUENCE
  Engineered FcRn binding polypeptide
VDAKYAKELRNAAHEIRWLPNLTFDQRVAFIHKLRDDPSQSSELLSEAKKLNDSQAPK

SEQ ID NO: 943 - protein, 58 aa, ARTIFICIAL SEQUENCE
  Engineered FcRn binding polypeptide
VDAKYAKEQRAAAHEIRWLPNLTFDQRVAFIHKLRDDPSQSSELLSEAKKLNDSQAPK

SEQ ID NO: 944 - protein, 58 aa, ARTIFICIAL SEQUENCE
  Engineered FcRn binding polypeptide
VDAKYAKEASEAAAEIRWLPNLTFDQRVAFIHKLRDDPSQSSELLSEAKKLNDSQAPK

SEQ ID NO: 945 - protein, 58 aa, ARTIFICIAL SEQUENCE
  Engineered FcRn binding polypeptide
VDAKYAKESVIAAHEIRWLPNLTFDQRVAFIHKLRDDPSQSSELLSEAKKLNDSQAPK

SEQ ID NO: 946 - protein, 58 aa, ARTIFICIAL SEQUENCE
  Engineered FcRn binding polypeptide
VDAKYAKEILRAKHEIRWLPNLTFDQRVAFIHKLDDDPSQSSELLSEAKKLNDSQAPK

SEQ ID NO: 947 - protein, 58 aa, ARTIFICIAL SEQUENCE
  Engineered FcRn binding polypeptide
VDAKYAKESKTAAHEIRWLPNLTFDQRVAFIQKLRDDPSQSSELLSEAKKLNDSQAPK

SEQ ID NO: 948 - protein, 58 aa, ARTIFICIAL SEQUENCE
  Engineered FcRn binding polypeptide
VDAKYAKELAEASHEIRWLPNLTFDQRVAFIHKLFDDPSQSSELLSEAKKLNDSQAPK

SEQ ID NO: 949 - protein, 58 aa, ARTIFICIAL SEQUENCE
  Engineered FcRn binding polypeptide
VDAKYAKEATTAKHEIRWLPNLTFDQRVAFIHKLDDDPSQSSELLSEAKKLNDSQAPK

SEQ ID NO: 950 - protein, 58 aa, ARTIFICIAL SEQUENCE
  Engineered FcRn binding polypeptide
VDAKYAKEIENAAHEIRWLPNLTFDQRVAFIHKLRDDPSQSSELLSEAKKLNDSQAPK

SEQ ID NO: 951 - protein, 58 aa, ARTIFICIAL SEQUENCE
  Engineered FcRn binding polypeptide
VDAKYAKEAKDAAHEIRWLPNLTFDQRVAFIRKLRDDPSQSSELLSEAKKLNDSQAPK

SEQ ID NO: 952 - protein, 58 aa, ARTIFICIAL SEQUENCE
  Engineered FcRn binding polypeptide
VDAKYAKERLEAAAEIRWLPNLTFDQRVAFIHKLRDDPSQSSELLSEAKKLNDSQAPK

SEQ ID NO: 953 - protein, 58 aa, ARTIFICIAL SEQUENCE
  Engineered FcRn binding polypeptide
VDAKYAKEQMEAAAEIRWLPNLTFDQRVAFIHKLRDDPSQSSELLSEAKKLNDSQAPK

SEQ ID NO: 954 - protein, 58 aa, ARTIFICIAL SEQUENCE
  Engineered FcRn binding polypeptide
VDAKYAKEVKTASHEIRWLPNLTFDQRVAFIRKLRDDPSQSSELLSEAKKLNDSQAPK

SEQ ID NO: 955 - protein, 58 aa, ARTIFICIAL SEQUENCE
  Engineered FcRn binding polypeptide
VDAKYAKESFEASHEIRWLPNLTFDQRVAFIQKLRDDPSQSSELLSEAKKLNDSQAPK

SEQ ID NO: 956 - protein, 58 aa, ARTIFICIAL SEQUENCE
  Engineered FcRn binding polypeptide
VDAKYAKEIKSAKHEIRWLPNLTFDQRVAFIHKLDDDPSQSSELLSEAKKLNDSQAPK

SEQ ID NO: 957 - protein, 58 aa, ARTIFICIAL SEQUENCE
  Engineered FcRn binding polypeptide
VDAKYAKEIKNAKHEIRWLPNLTFDQRVAFIHKLDDDPSQSSELLSEAKKLNDSQAPK

SEQ ID NO: 958 - protein, 58 aa, ARTIFICIAL SEQUENCE
  Engineered FcRn binding polypeptide
VDAKYAKELQEAKHEIRWLPNLTFDQRVAFIHKLDDDPSQSSELLSEAKKLNDSQAPK

SEQ ID NO: 959 - protein, 58 aa, ARTIFICIAL SEQUENCE
  Engineered FcRn binding polypeptide
VDAKYAKERQNAAHEIRWLPNLTFDQRVAFIRKLRDDPSQSSELLSEAKKLNDSQAPK

SEQ ID NO: 960 - protein, 58 aa, ARTIFICIAL SEQUENCE
  Engineered FcRn binding polypeptide
VDAKYAKEVLQAKHEIRWLPNLTFDQRVAFIHKLDDDPSQSSELLSEAKKLNDSQAPK

SEQ ID NO: 961 - protein, 58 aa, ARTIFICIAL SEQUENCE
  Engineered FcRn binding polypeptide
VDAKYAKEANVASHEIRWLPNLTFDQRVAFIHKLRDDPSQSSELLSEAKKLNDSQAPK

SEQ ID NO: 962 - protein, 58 aa, ARTIFICIAL SEQUENCE
  Engineered FcRn binding polypeptide
VDAKYAKELDAAKHEIRWLPNLTFDQRVAFIHKLDDDPSQSSELLSEAKKLNDSQAPK

SEQ ID NO: 963 - protein, 58 aa, ARTIFICIAL SEQUENCE
  Engineered FcRn binding polypeptide
VDAKYAKETASAAHEIRWLPNLTFDQRVAFIHKLNDDPSQSSELLSEAKKLNDSQAPK

SEQ ID NO: 964 - protein, 58 aa, ARTIFICIAL SEQUENCE
  Engineered FcRn binding polypeptide
VDAKYAKEWKQAASEIRWLPNLTFDQRVAFIHKLRDDPSQSSELLSEAKKLNDSQAPK

SEQ ID NO: 965 - protein, 58 aa, ARTIFICIAL SEQUENCE
  Engineered FcRn binding polypeptide
VDAKYAKETASASHEIRWLPNLTFDQRVAFIHKLQDDPSQSSELLSEAKKLNDSQAPK

SEQ ID NO: 966 - protein, 58 aa, ARTIFICIAL SEQUENCE
  Engineered FcRn binding polypeptide
VDAKYAKESIVAGHEIRWLPNLTFDQRVAFIHKLRDDPSQSSELLSEAKKLNDSQAPK

SEQ ID NO: 967 - protein, 58 aa, ARTIFICIAL SEQUENCE
  Engineered FcRn binding polypeptide
VDAKYAKEIKQAKHEIRWLPNLTFDQRVAFIHKLDDDPSQSSELLSEAKKLNDSQAPK

SEQ ID NO: 968 - protein, 58 aa, ARTIFICIAL SEQUENCE
  Engineered FcRn binding polypeptide
VDAKYAKEQATASHEIRWLPNLTFDQRVAFIRKLRDDPSQSSELLSEAKKLNDSQAPK

SEQ ID NO: 969 - protein, 58 aa, ARTIFICIAL SEQUENCE
  Engineered FcRn binding polypeptide
VDAKYAKELNAAKHEIRWLPNLTFDQRVAFIHKLDDDPSQSSELLSEAKKLNDSQAPK

SEQ ID NO: 970 - protein, 58 aa, ARTIFICIAL SEQUENCE
  Engineered FcRn binding polypeptide
VDAKYAKEVKRAGHEIRWLPNLTFDQRVAFIRKLRDDPSQSSELLSEAKKLNDSQAPK

SEQ ID NO: 971 - protein, 58 aa, ARTIFICIAL SEQUENCE
  Engineered FcRn binding polypeptide
VDAKYAKESRNAAHEIRWLPNLTFDQRVAFIHKLQDDPSQSSELLSEAKKLNDSQAPK

SEQ ID NO: 972 - protein, 58 aa, ARTIFICIAL SEQUENCE
  Engineered FcRn binding polypeptide
VDAKYAKESITASAEIRWLPNLTFDQRVAFIRKLRDDPSQSSELLSEAKKLNDSQAPK

SEQ ID NO: 973 - protein, 58 aa, ARTIFICIAL SEQUENCE
  Engineered FcRn binding polypeptide
VDAKYAKEAATAAHEIRWLPNLTFDQRVAFIHKLQDDPSQSSELLSEAKKLNDSQAPK

SEQ ID NO: 974 - protein, 58 aa, ARTIFICIAL SEQUENCE
  Engineered FcRn binding polypeptide
VDAKYAKEVYAAKHEIRWLPNLTFDQRVAFIHKLDDDPSQSSELLSEAKKLNDSQAPK

SEQ ID NO: 975 - protein, 58 aa, ARTIFICIAL SEQUENCE
  Engineered FcRn binding polypeptide
VDAKYAKEISRAKHEIRWLPNLTFDQRVAFIHKLDDDPSQSSELLSEAKKLNDSQAPK

SEQ ID NO: 976 - protein, 58 aa, ARTIFICIAL SEQUENCE
  Engineered FcRn binding polypeptide
VDAKYAKEYVTAAHEIRWLPNLTFDQRVAFIHKLRDDPSQSSELLSEAKKLNDSQAPK

SEQ ID NO: 977 - protein, 58 aa, ARTIFICIAL SEQUENCE
  Engineered FcRn binding polypeptide
VDAKYAKEHIDAGHEIRWLPNLTFDQRVAFIHKLRDDPSQSSELLSEAKKLNDSQAPK

SEQ ID NO: 978 - protein, 58 aa, ARTIFICIAL SEQUENCE
  Engineered FcRn binding polypeptide
VDAKYAKEILQAKHEIRWLPNLTFDQRVAFIHKLNDDPSQSSELLSEAKKLNDSQAPK

SEQ ID NO: 979 - protein, 58 aa, ARTIFICIAL SEQUENCE
  Engineered FcRn binding polypeptide
VDAKYAKENSQAKHEIRWLPNLTFDQRVAFIHKLNDDPSQSSELLSEAKKLNDSQAPK

SEQ ID NO: 980 - protein, 58 aa, ARTIFICIAL SEQUENCE
  Engineered FcRn binding polypeptide
VDAKYAKEYRVAAKEIRWLPNLTFDQRVAFIHKLRDDPSQSSELLSEAKKLNDSQAPK

SEQ ID NO: 981 - protein, 58 aa, ARTIFICIAL SEQUENCE
  Engineered FcRn binding polypeptide
VDAKYAKEIYNAGHEIRWLPNLTFDQRVAFIRKLRDDPSQSSELLSEAKKLNDSQAPK

SEQ ID NO: 982 - protein, 58 aa, ARTIFICIAL SEQUENCE
  Engineered FcRn binding polypeptide
VDAKYAKESNEAAAEIRWLPNLTFDQRVAFIHKLRDDPSQSSELLSEAKKLNDSQAPK

SEQ ID NO: 983 - protein, 58 aa, ARTIFICIAL SEQUENCE
  Engineered FcRn binding polypeptide
VDAKYAKESQLAAAEIRWLPNLTFDQRVAFIRKLRDDPSQSSELLSEAKKLNDSQAPK

SEQ ID NO: 984 - protein, 58 aa, ARTIFICIAL SEQUENCE
  Engineered FcRn binding polypeptide
VDAKYAKELKEAGHEIRWLPNLTFDQRVAFIHKLQDDPSQSSELLSEAKKLNDSQAPK

SEQ ID NO: 985 - protein, 58 aa, ARTIFICIAL SEQUENCE
  Engineered FcRn binding polypeptide
VDAKYAKETRVASVEIRWLPNLTFDQRVAFIQKLNDDPSQSSELLSEAKKLNDSQAPK

SEQ ID NO: 986 - protein, 58 aa, ARTIFICIAL SEQUENCE
  Engineered FcRn binding polypeptide
VDAKYAKELRTAAHEIRWLPNLTFDQRVAFIHKLNDDPSQSSELLSEAKKLNDSQAPK

SEQ ID NO: 987 - protein, 58 aa, ARTIFICIAL SEQUENCE
  Engineered FcRn binding polypeptide
VDAKYAKEKTYAHFEIRWLPNLTFDQRVAFISKLWDDPSQSSELLSEAKKLNDSQAPK

SEQ ID NO: 988 - protein, 58 aa, ARTIFICIAL SEQUENCE
  Engineered FcRn binding polypeptide
VDAKYAKEEAQASHEIRWLPNLTFDQRVAFIHKLRDDPSQSSELLSEAKKLNDSQAPK

SEQ ID NO: 989 - protein, 58 aa, ARTIFICIAL SEQUENCE
  Engineered FcRn binding polypeptide
VDAKYAKEITSAAHEIRWLPNLTFDQRVAFIHKLRDDPSQSSELLSEAKKLNDSQAPK

SEQ ID NO: 990 - protein, 58 aa, ARTIFICIAL SEQUENCE
  Engineered FcRn binding polypeptide
VDAKYAKEVKTASHEIRWLPNLTFDQRVAFIHKLKDDPSQSSELLSEAKKLNDSQAPK

SEQ ID NO: 991 - protein, 58 aa, ARTIFICIAL SEQUENCE
  Engineered FcRn binding polypeptide
VDAKYAKETKVAAHEIRWLPNLTFDQRVAFIHKLRDDPSQSSELLSEAKKLNDSQAPK

SEQ ID NO: 992 - protein, 58 aa, ARTIFICIAL SEQUENCE
  Engineered FcRn binding polypeptide
VDAKYAKEDLVAQHEIRWLPNLTFDQRVAFIRKLRDDPSQSSELLSEAKKLNDSQAPK

SEQ ID NO: 993 - protein, 58 aa, ARTIFICIAL SEQUENCE
  Engineered FcRn binding polypeptide
VDAKYAKETQTAFNEIRWLPNLTYDQRAAFILKLWDDPSQSSELLSEAKKLNDSQAPK

SEQ ID NO: 994 - protein, 58 aa, ARTIFICIAL SEQUENCE
  Engineered FcRn binding polypeptide
VDAKYAKEIKDAGHEIRWLPNLTFDQRVAFIRKLRDDPSQSSELLSEAKKLNDSQAPK

SEQ ID NO: 995 - protein, 58 aa, ARTIFICIAL SEQUENCE
  Engineered FcRn binding polypeptide
VDAKYAKEYKEAGHEIRWLPNLTYDQRVAFIVKLRDDPSQSSELLSEAKKLNDSQAPK

SEQ ID NO: 996 - protein, 58 aa, ARTIFICIAL SEQUENCE
  Engineered FcRn binding polypeptide
VDAKYAKEAALAAHEIRWLPNLTFDQRVAFIHKLKDDPSQSSELLSEAKKLNDSQAPK

SEQ ID NO: 997 - protein, 58 aa, ARTIFICIAL SEQUENCE
  Engineered FcRn binding polypeptide
VDAKYAKEQERAAHEIRWLPNLTFDQRVAFIRKLRDDPSQSSELLSEAKKLNDSQAPK

SEQ ID NO: 998 - protein, 58 aa, ARTIFICIAL SEQUENCE
  Engineered FcRn binding polypeptide
VDAKYAKEWFDAAHEIRWLPNLTFDQRVAFIRKLRDDPSQSSELLSEAKKLNDSQAPK

SEQ ID NO: 999 - protein, 58 aa, ARTIFICIAL SEQUENCE
  Engineered FcRn binding polypeptide
VDAKYAKEIIQAKHEIRWLPNLTFDQRVAFIHKLDDDPSQSSELLSEAKKLNDSQAPK

SEQ ID NO: 1000 - protein, 58 aa, ARTIFICIAL SEQUENCE
  Engineered FcRn binding polypeptide
VDAKYAKELTNAKHEIRWLPNLTFDQRVAFIHKLDDDPSQSSELLSEAKKLNDSQAPK

SEQ ID NO: 1001 - protein, 58 aa, ARTIFICIAL SEQUENCE
  Engineered FcRn binding polypeptide
VDAKYAKEIQLAKHEIRWLPNLTFDQRVAFIHKLDDDPSQSSELLSEAKKLNDSQAPK

SEQ ID NO: 1002 - protein, 58 aa, ARTIFICIAL SEQUENCE
  Engineered FcRn binding polypeptide
VDAKYAKEIHDAKHEIRWLPNLTFDQRVAFIHKLQDDPSQSSELLSEAKKLNDSQAPK

SEQ ID NO: 1003 - protein, 58 aa, ARTIFICIAL SEQUENCE
  Engineered FcRn binding polypeptide
VDAKYAKEVKIASHEIRWLPNLTFDQRVAFIHKLRDDPSQSSELLSEAKKLNDSQAPK

SEQ ID NO: 1004 - protein, 58 aa, ARTIFICIAL SEQUENCE
  Engineered FcRn binding polypeptide
VDAKYAKEQHSAAHEIRWLPNLTFDQRVAFIRKLRDDPSQSSELLSEAKKLNDSQAPK

SEQ ID NO: 1005 - protein, 58 aa, ARTIFICIAL SEQUENCE
  Engineered FcRn binding polypeptide
VDAKYAKEVFAASAEIRWLPNLTFDQRVAFIHKLRDDPSQSSELLSEAKKLNDSQAPK

SEQ ID NO: 1006 - protein, 58 aa, ARTIFICIAL SEQUENCE
  Engineered FcRn binding polypeptide
VDAKYAKETDLAGHEIRWLPNLTFDQRVAFIRKLRDDPSQSSELLSEAKKLNDSQAPK

SEQ ID NO: 1007 - protein, 58 aa, ARTIFICIAL SEQUENCE
  Engineered FcRn binding polypeptide
VDAKYAKEANFAGHEIRWLPNLTFDQRVAFIRKLRDDPSQSSELLSEAKKLNDSQAPK

SEQ ID NO: 1008 - protein, 58 aa, ARTIFICIAL SEQUENCE
  Engineered FcRn binding polypeptide
VDAKYAKEFETAGHEIRWLPNLTFDQRVAFITKLWDDPSQSSELLSEAKKLNDSQAPK

SEQ ID NO: 1009 - protein, 58 aa, ARTIFICIAL SEQUENCE
  Engineered FcRn binding polypeptide
VDAKYAKEVNLAKHEIRWLPNLTFDQRVAFIHKLDDDPSQSSELLSEAKKLNDSQAPK

SEQ ID NO: 1010 - protein, 58 aa, ARTIFICIAL SEQUENCE
  Engineered FcRn binding polypeptide
VDAKYAKEADTAAHEIRWLPNLTFDQRVAFIYKLRDDPSQSSELLSEAKKLNDSQAPK

SEQ ID NO: 1011 - protein, 58 aa, ARTIFICIAL SEQUENCE
  Engineered FcRn binding polypeptide
VDAKYAKEFVDAGHEIRWLPNLTFDQRVAFIQKLRDDPSQSSELLSEAKKLNDSQAPK

SEQ ID NO: 1012 - protein, 58 aa, ARTIFICIAL SEQUENCE
  Engineered FcRn binding polypeptide
VDAKYAKEDHKAEHEIRWLPNLTFDQRVAFIHKLRDDPSQSSELLSEAKKLNDSQAPK

SEQ ID NO: 1013 - protein, 58 aa, ARTIFICIAL SEQUENCE
  Engineered FcRn binding polypeptide
VDAKYAKETVDAGHEIRWLPNLTFDQRVAFIHKLADDPSQSSELLSEAKKLNDSQAPK

SEQ ID NO: 1014 - protein, 58 aa, ARTIFICIAL SEQUENCE
  Engineered FcRn binding polypeptide
VDAKYAKESQRAGHEIRWLPNLTFDQRVAFITKLRDDPSQSSELLSEAKKLNDSQAPK

SEQ ID NO: 1015 - protein, 58 aa, ARTIFICIAL SEQUENCE
  Engineered FcRn binding polypeptide
VDAKYAKEWSSAAHEIRWLPNLTFDQRVAFIHKLQDDPSQSSELLSEAKKLNDSQAPK

SEQ ID NO: 1016 - protein, 58 aa, ARTIFICIAL SEQUENCE
  Engineered FcRn binding polypeptide
VDAKYAKEVAVAGHEIRWLPNLTYDQRVAFIVKLRDDPSQSSELLSEAKKLNDSQAPK

SEQ ID NO: 1017 - protein, 58 aa, ARTIFICIAL SEQUENCE
  Engineered FcRn binding polypeptide
VDAKYAKESAEAGHEIRWLPNLTFDQRVAFIEKLRDDPSQSSELLSEAKKLNDSQAPK

SEQ ID NO: 1018 - protein, 58 aa, ARTIFICIAL SEQUENCE
  Engineered FcRn binding polypeptide
VDAKYAKEAVAAGHEIRWLPNLTFDQRVAFIHKLNDDPSQSSELLSEAKKLNDSQAPK

SEQ ID NO: 1019 - protein, 58 aa, ARTIFICIAL SEQUENCE
  Engineered FcRn binding polypeptide
VDAKYAKEFQIAGHEIRWLPNLTFDQRVAFINKLRDDPSQSSELLSEAKKLNDSQAPK

SEQ ID NO: 1020 - protein, 58 aa, ARTIFICIAL SEQUENCE
  Engineered FcRn binding polypeptide
VDAKYAKELMVAKHEIRWLPNLTFDQRVAFIHKLDDDPSQSSELLSEAKKLNDSQAPK

SEQ ID NO: 1021 - protein, 58 aa, ARTIFICIAL SEQUENCE
  Engineered FcRn binding polypeptide
VDAKYAKEYDSAAHEIRWLPNLTYDQRVAFILKLRDDPSQSSELLSEAKKLNDSQAPK

SEQ ID NO: 1022 - protein, 58 aa, ARTIFICIAL SEQUENCE
  Engineered FcRn binding polypeptide
VDAKYAKEVLEAKHEIRWLPNLTFDQRVAFIHKLDDDPSQSSELLSEAKKLNDSQAPK

SEQ ID NO: 1023 - protein, 58 aa, ARTIFICIAL SEQUENCE
  Engineered FcRn binding polypeptide
VDAKYAKESIAASHEIRWLPNLTFDQRVAFIHKLRDDPSQSSELLSEAKKLNDSQAPK

SEQ ID NO: 1024 - protein, 58 aa, ARTIFICIAL SEQUENCE
  Engineered FcRn binding polypeptide
VDAKYAKEVAEAGHEIRWLPNLTFDQRVAFISKLRDDPSQSSELLSEAKKLNDSQAPK

SEQ ID NO: 1025 - protein, 58 aa, ARTIFICIAL SEQUENCE
  Engineered FcRn binding polypeptide
VDAKYAKEQAKAAHEIRWLPNLTFDQRVAFIHKLNDDPSQSSELLSEAKKLNDSQAPK

SEQ ID NO: 1026 - protein, 58 aa, ARTIFICIAL SEQUENCE
  Engineered FcRn binding polypeptide
VDAKYAKERDDAAHEIRWLPNLTFDQRVAFIEKLRDDPSQSSELLSEAKKLNDSQAPK

SEQ ID NO: 1027 - protein, 58 aa, ARTIFICIAL SEQUENCE
  Engineered FcRn binding polypeptide
VDAKYAKEAKDASHEIRWLPNLTFDQRVAFIHKLRDDPSQSSELLSEAKKLNDSQAPK

SEQ ID NO: 1028 - protein, 58 aa, ARTIFICIAL SEQUENCE
  Engineered FcRn binding polypeptide
VDAKYAKEASSAAHEIRWLPNLTFDQRVAFIQKLRDDPSQSSELLSEAKKLNDSQAPK

SEQ ID NO: 1029 - protein, 58 aa, ARTIFICIAL SEQUENCE
  Engineered FcRn binding polypeptide
VDAKYAKEWMEASHEIRWLPNLTYDQRVAFIVKLRDDPSQSSELLSEAKKLNDSQAPK

SEQ ID NO: 1030 - protein, 58 aa, ARTIFICIAL SEQUENCE
  Engineered FcRn binding polypeptide
VDAKYAKEQKNAAHEIRWLPNLTFDQRVAFIEKLRDDPSQSSELLSEAKKLNDSQAPK

SEQ ID NO: 1031 - protein, 58 aa, ARTIFICIAL SEQUENCE
  Engineered FcRn binding polypeptide
VDAKYAKEIENAKHEIRWLPNLTFDQRVAFIHKLDDDPSQSSELLSEAKKLNDSQAPK

SEQ ID NO: 1032 - protein, 58 aa, ARTIFICIAL SEQUENCE
  Engineered FcRn binding polypeptide
VDAKYAKEVNRASHEIRWLPNLTFDQRVAFIHKLLDDPSQSSELLSEAKKLNDSQAPK

SEQ ID NO: 1033 - protein, 58 aa, ARTIFICIAL SEQUENCE
  Engineered FcRn binding polypeptide
VDAKYAKERLLAGHEIRWLPNLTFDQRVAFINKLRDDPSQSSELLSEAKKLNDSQAPK

SEQ ID NO: 1034 - protein, 58 aa, ARTIFICIAL SEQUENCE
  Engineered FcRn binding polypeptide
VDAKYAKEVSIAGHEIRWLPNLTFDQRVAFIRKLRDDPSQSSELLSEAKKLNDSQAPK

SEQ ID NO: 1035 - protein, 58 aa, ARTIFICIAL SEQUENCE
  Engineered FcRn binding polypeptide
VDAKYAKEKEVAAHEIRWLPNLTFDQRVAFIHKLDDDPSQSSELLSEAKKLNDSQAPK

SEQ ID NO: 1036 - protein, 58 aa, ARTIFICIAL SEQUENCE
  Engineered FcRn binding polypeptide
VDAKYAKESERASHEIRWLPNLTFDQRVAFIHKLRDDPSQSSELLSEAKKLNDSQAPK

SEQ ID NO: 1037 - protein, 58 aa, ARTIFICIAL SEQUENCE
  Engineered FcRn binding polypeptide
VDAKYAKEWNEAAHEIRWLPNLTFDQRVAFIHKLRDDPSQSSELLSEAKKLNDSQAPK

SEQ ID NO: 1038 - protein, 58 aa, ARTIFICIAL SEQUENCE
  Engineered FcRn binding polypeptide
VDAKYAKENVDAAHEIRWLPNLTFDQRVAFIHKLRDDPSQSSELLSEAKKLNDSQAPK

SEQ ID NO: 1039 - protein, 58 aa, ARTIFICIAL SEQUENCE
  Engineered FcRn binding polypeptide
VDAKYAKEADAASHEIRWLPNLTFDQRVAFIRKLRDDPSQSSELLSEAKKLNDSQAPK

SEQ ID NO: 1040 - protein, 58 aa, ARTIFICIAL SEQUENCE
  Engineered FcRn binding polypeptide
VDAKYAKELESASHEIRWLPNLTFDQRVAFIHKLIDDPSQSSELLSEAKKLNDSQAPK

SEQ ID NO: 1041 - protein, 58 aa, ARTIFICIAL SEQUENCE
  Engineered FcRn binding polypeptide
VDAKYAKEEQLAAHEIRWLPNLTFDQRVAFIRKLRDDPSQSSELLSEAKKLNDSQAPK

SEQ ID NO: 1042 - protein, 58 aa, ARTIFICIAL SEQUENCE
  Engineered FcRn binding polypeptide
VDAKYAKEFELAGHEIRWLPNLTFDQRVAFIHKLDDDPSQSSELLSEAKKLNDSQAPK

SEQ ID NO: 1043 - protein, 58 aa, ARTIFICIAL SEQUENCE
  Engineered FcRn binding polypeptide
VDAKYAKEAFVAQHEIRWLPNLTYDQRVAFIVKLRDDPSQSSELLSEAKKLNDSQAPK

SEQ ID NO: 1044 - protein, 58 aa, ARTIFICIAL SEQUENCE
  Engineered FcRn binding polypeptide
VDAKYAKEALKASHEIRWLPNLTFDQRVAFINKLRDDPSQSSELLSEAKKLNDSQAPK

SEQ ID NO: 1045 - protein, 58 aa, ARTIFICIAL SEQUENCE
  Engineered FcRn binding polypeptide
VDAKYAKELERAGHEIRWLPNLTFDQRVAFIKKLTDDPSQSSELLSEAKKLNDSQAPK

SEQ ID NO: 1046 - protein, 58 aa, ARTIFICIAL SEQUENCE
  Engineered FcRn binding polypeptide
VDAKYAKEVEWAKHEIRWLPNLTFDQRVAFIHKLQDDPSQSSELLSEAKKLNDSQAPK

SEQ ID NO: 1047 - protein, 58 aa, ARTIFICIAL SEQUENCE
  Engineered FcRn binding polypeptide
VDAKYAKEKASAQHEIRWLPNLTFDQRVAFIHKLDDDPSQSSELLSEAKKLNDSQAPK

SEQ ID NO: 1048 - protein, 58 aa, ARTIFICIAL SEQUENCE
  Engineered FcRn binding polypeptide
VDAKYAKETEIAKHEIRWLPNLTFDQRVAFIHKLDDDPSQSSELLSEAKKLNDSQAPK

SEQ ID NO: 1049 - protein, 58 aa, ARTIFICIAL SEQUENCE
  Engineered FcRn binding polypeptide
VDAKYAKEVNLAAHEIRWLPNLTFDQRVAFIHKLTDDPSQSSELLSEAKKLNDSQAPK

SEQ ID NO: 1050 - protein, 58 aa, ARTIFICIAL SEQUENCE
  Engineered FcRn binding polypeptide
VDAKYAKEAEEAAHEIRWLPNLTFDQRVAFIHKLRDDPSQSSELLSEAKKLNDSQAPK

SEQ ID NO: 1051 - protein, 58 aa, ARTIFICIAL SEQUENCE
  Engineered FcRn binding polypeptide
VDAKYAKETDRAKHEIRWLPNLTFDQRVAFIHKLNDDPSQSSELLSEAKKLNDSQAPK

SEQ ID NO: 1052 - protein, 58 aa, ARTIFICIAL SEQUENCE
  Engineered FcRn binding polypeptide
VDAKYAKEFAQAGHEIRWLPNLTFDQRVAFIHKLKDDPSQSSELLSEAKKLNDSQAPK

SEQ ID NO: 1053 - protein, 58 aa, ARTIFICIAL SEQUENCE
  Engineered FcRn binding polypeptide
VDAKYAKETDEASHEIRWLPNLTFDQRVAFIRKLRDDPSQSSELLSEAKKLNDSQAPK

SEQ ID NO: 1054 - protein, 58 aa, ARTIFICIAL SEQUENCE
  Engineered FcRn binding polypeptide
VDAKYAKENADAGHEIRWLPNLTFDQRVAFIQKLRDDPSQSSELLSEAKKLNDSQAPK

SEQ ID NO: 1055 - protein, 58 aa, ARTIFICIAL SEQUENCE
  Engineered FcRn binding polypeptide
VDAKYAKESTQAAHEIRWLPNLTFDQRVAFIHKLQDDPSQSSELLSEAKKLNDSQAPK

SEQ ID NO: 1056 - protein, 58 aa, ARTIFICIAL SEQUENCE
  Engineered FcRn binding polypeptide
VDAKYAKEQALAAHEIRWLPNLTFDQRVAFIHKLNDDPSQSSELLSEAKKLNDSQAPK

SEQ ID NO: 1057 - protein, 58 aa, ARTIFICIAL SEQUENCE
  Engineered FcRn binding polypeptide
VDAKYAKEAHAASHEIRWLPNLTFDQRVAFIHKLDDDPSQSSELLSEAKKLNDSQAPK

SEQ ID NO: 1058 - protein, 58 aa, ARTIFICIAL SEQUENCE
  Engineered FcRn binding polypeptide
VDAKYAKEVDNAGHEIRWLPNLTFDQRVAFIQKLRDDPSQSSELLSEAKKLNDSQAPK

SEQ ID NO: 1059 - protein, 58 aa, ARTIFICIAL SEQUENCE
  Engineered FcRn binding polypeptide
VDAKYAKEAGRAAHEIRWLPNLTWDQRVAFIWKLRDDPSQSSELLSEAKKLNDSQAPK

SEQ ID NO: 1060 - protein, 58 aa, ARTIFICIAL SEQUENCE
  Engineered FcRn binding polypeptide
AEAKYAKEQDAAAHEIRWLPNLTFDQRVAFIHKLADDPSQSSELLSEAKKLNDSQAPK

SEQ ID NO: 1061 - protein, 58 aa, ARTIFICIAL SEQUENCE
  Engineered FcRn binding polypeptide
AEAKYAKEFESAAHEIRWLPNLTYDQRVAFIHKLSDDPSQSSELLSEAKKLNDSQAPK

SEQ ID NO: 1062 - protein, 58 aa, ARTIFICIAL SEQUENCE
  Engineered FcRn binding polypeptide
AEAKYAKEWMRAAHEIRWLPNLTFDQRVAFIHKLEDDPSQSSELLSEAKKLNDSQAPK

SEQ ID NO: 1063 - protein, 46 aa, ARTIFICIAL SEQUENCE
  Engineered albumin binding polypeptide
LAEAKEAANAELDSYGVSDFYKRLIDKAKTVEGVEALKDAILAALP

SEQ ID NO: 1064 - protein, 58 aa, ARTIFICIAL SEQUENCE
  Engineered binding polypeptide
AEAKYAKELGWATWEIFNLPNLTGVQVKAFIDKLRDDPSQSSELLSEAKKLNDSQAPK

SEQ ID NO: 1065 - protein, 267 aa, HOMO SAPIENS
AESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVEL

SEQ ID NO: 1066 - protein, 99 aa, HOMO SAPIENS [sequence omitted]

SEQ ID NO: 1067 - protein, 99 aa, MUS MUSCULUS [sequence omitted]

SEQ ID NO: 1068 - protein, 365 aa, ARTIFICIAL SEQUENCE
  hFcRn - eGFP fusion protein
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 1069 - protein, 369 aa, ARTIFICIAL SEQUENCE
  mFcRn - eGFP fusion protein
MGMPLPWALSLLLVLLPQTWGSETRPPLMYHLTAVSNPSTGLPSFWATGWLGPQQYLTYNSLRQEADPCGAWMWENQVSWYWEKETTDLKSKEQLFLEALKTLEKILNGQKRGTYTLQGLLGCELASDNSSVPTAVFALNGEEFMKFNPRIGNWTGEWPETEIVANLWMKQPDAARKESEFLLNSCPERLLGHLERGRRNLEWKEPPSMRLKARPGNSGSSVLTCAAFSFYPPELKFRFLRNGLASGSGNCSTGPNGDGSFHAWSLLEVKRGDEHHYQCQVEHEGLAQPLTVDLDSSARSSVPVVGIVLGLLLVVVAIAGGVLLWGRMRSGLPAPWLSLSGDDSGDLLPGGNLPPEAEPQGANAFPATS

SEQ ID NO: 1070 - protein, 273 aa, MUS MUSCULUS
SETRPPLMYHLTAVSNPSTGLPSFWATGWLGPQQYLTYNSLRQEADPCGAWMWENQVSWYWEKETTDLKSKEQLFLEALKTLEKILNGQKRGTYTLQGLLGCELASDNSSVPTAVFALNGEEFMKFNPRIGNWTGEWPETEIVANLWMKQPDAARKESEFLLNSCPERLLGHLERGRRNLEWKEPPSMRLKARPGNSGSSVLTCAAFSFYPPELKFRFLRNGLASGSGNCSTGPNGDGSFHAWSLLEVKRGDEHHYQCQVEHEGLAQPLTVDL

SEQ ID NO: 1071 - DNA, 24 bp, ARTIFICIAL SEQUENCE
  PCR primer
tgcttccggctcgtatgttgtgtg

SEQ ID NO: 1072 - DNA, 21 bp, ARTIFICIAL SEQUENCE
  PCR primer
cggaaccagagccaccaccgg

SEQ ID NO: 1073 - DNA, 21 bp, ARTIFICIAL SEQUENCE
  Sequencing primer
cggaaccagagccaccaccgg

SEQ ID NO: 1074 - DNA, 147 bp, ARTIFICIAL SEQUENCE
  Library polynucleotide
  misc_feature (39)..(47): n is a, c, g, or t
  misc_feature (51)..(56): n is a, c, g, or t
  misc_feature (63)..(68): n is a, c, g, or t
  misc_feature (84)..(89): n is a, c, g, or t
  misc_feature (93)..(98): n is a, c, g, or t
  misc_feature (108)..(110): n is a, c, g, or t
  misc_feature (117)..(119): n is a, c, g, or t
aaataaatctcgaggtagatgccaaatacgccaaagaannnnnnnnngcgnnnnnngagatcnnnnnnttacctaacttaaccnnnnnncaannnnnngccttcatcnnnaaattannngatgacccaagccagagctcattattta

SEQ ID NO: 1075 - protein, 29 aa, Artificial Sequence
  Engineered Polypeptide
  MISC_FEATURE (2)..(2): Xaa is selected from A, D, E, F, H, I, K, L, N, Q, R, S, T, V, W and Y.
  MISC_FEATURE (3)..(3): Xaa is selected from A, D, E, F, G, H, I, K, L, M, N, Q, R, S, T, V, W and Y.
  MISC_FEATURE (4)..(4): Xaa is selected from A, D, E, F, G, H, I, K, L, N, Q, R, S, T, V, W and Y.
  MISC_FEATURE (6)..(6): Xaa is selected from A, D, E, F, G, H, I, K, L, N, Q, R, S, T, V, W and Y.
  MISC_FEATURE (7)..(7): Xaa is selected from A, F, H, I, K, L, N, Q, R, S, T, V, W and Y.
  MISC_FEATURE (16)..(16): Xaa is selected from N and T.
  MISC_FEATURE (17)..(17): Xaa is selected from F, W and Y.
  MISC_FEATURE (18)..(18): Xaa is selected from A, D, E and N.
  MISC_FEATURE (21)..(21): Xaa is selected from A, S, V and W.
  MISC_FEATURE (25)..(25): Xaa is selected from A, D, E, F, G, H, I, K, L, N, Q, R, S, T, V, W and Y.
  MISC_FEATURE (26)..(26): Xaa is selected from K and S.
  MISC_FEATURE (28)..(28): Xaa is selected from A, D, E, F, H, I, K, L, N, Q, R, S, T, V, W and Y.
  MISC_FEATURE (29)..(29): Xaa is selected from D and R
EXXXAXXEIRWLPNLXXXQRXAFIXXLXX

SEQ ID NO: 1076 - protein, 29 aa, Artificial Sequence
  Engineered Polypeptide
  MISC_FEATURE (2)..(2): Xaa is selected from A, D, E, F, H, I, K, L, N, Q, R, S, T, V, W and Y.
  MISC_FEATURE (3)..(3): Xaa is selected from A, D, E, F, G, H, I, K, L, M, N, Q, R, S, T, V, W and Y.
  MISC_FEATURE (4)..(4): Xaa is selected from A, D, E, F, G, H, I, K, L, N, Q, R, S, T, V, W and Y.
  MISC_FEATURE (6)..(6): Xaa is selected from A, D, E, F, G, H, I, K, L, N, Q, R, S, T, V, W and Y.
  MISC_FEATURE (7)..(7): Xaa is selected from A, F, H, I, K, L, N, Q, R, S, T, V, W and Y.
  MISC_FEATURE (17)..(17): Xaa is selected from F, W and Y.
  MISC_FEATURE (18)..(18): Xaa is selected from A, D, E and N.
  MISC_FEATURE (21)..(21): Xaa is selected from A, S, V and W.
  MISC_FEATURE (25)..(25): Xaa is selected from A, D, E, F, G, H, I, K, L, N, Q, R, S, T, V, W and Y.
  MISC_FEATURE (28)..(28): Xaa is selected from A, D, E, F, H, I, K, L, N, Q, R, S, T, V, W and Y.
EXXXAXXEIRWLPNLTXXQRXAFIXKLXD

SEQ ID NO: 1077 - protein, 20 aa, Artificial Sequence
  Engineered Polypeptide
  MISC_FEATURE (1)..(2): FcRn binding motif
  MISC_FEATURE (7)..(7): Xaa is selected from A and S.
  MISC_FEATURE (8)..(8): Xaa is selected from N and E.
  MISC_FEATURE (11)..(11): Xaa is selected from A, S and C.
  MISC_FEATURE (17)..(17): Xaa is selected from E, N and S.
  MISC_FEATURE (18)..(18): Xaa is selected from D, E and S.
  MISC_FEATURE (19)..(19): Xaa is selected from A and S.
KDPSQSXXLLXEAKKLXXXQ

SEQ ID NO: 1078 - protein, 29 aa, Artificial Sequence
  Engineered Polypeptide
  MISC_FEATURE (7)..(8): FcRn binding motif.
AEAKYAKDPSQSSELLSEAKKLNDSQAPK

SEQ ID NO: 1079 - protein, 29 aa, Artificial Sequence
  Engineered Polypeptide
  MISC_FEATURE (7)..(8): FcRn binding motif.
VDAKYAKDPSQSSELLSEAKKLNDSQAPK

SEQ ID NO: 1080 - protein, 20 aa, Artificial Sequence
  Engineered Polypeptide
  MISC_FEATURE (1)..(2): FcRn binding motif.
  MISC_FEATURE (7)..(7): Xaa is selected from A and S.
  MISC_FEATURE (8)..(8): Xaa is selected from N and E.
  MISC_FEATURE (11)..(11): Xaa is selected from A, S and C.
  MISC_FEATURE (17)..(17): Xaa is selected from E, N and S.
  MISC_FEATURE (18)..(18): Xaa is selected from D, E and S.
  MISC_FEATURE (19)..(19): Xaa is selected from A and S.
KQPEQSXXLLXEAKKLXXXQ

SEQ ID NO: 1081 - protein, 24 aa, Artificial Sequence
  Engineered Polypeptide
  MISC_FEATURE (3)..(4): FcRn binding motif.
  MISC_FEATURE (13)..(13): Xaa is selected from A, S and C.
YAKDPSQSSELLXEAKKLNDSQAP

SEQ ID NO: 1082 - protein, 24 aa, Artificial Sequence
  Engineered Polypeptide
  MISC_FEATURE (3)..(4): FcRn binding motif.
  MISC_FEATURE (13)..(13): Xaa is selected from A and C.
FNKDPSQSANLLXEAKKLNDAQAP

SEQ ID NO: 1083 - protein, 29 aa, Artificial Sequence
  Engineered Polypeptide
  MISC_FEATURE (7)..(8): FcRn binding motif.
ADNNFNKDPSQSANLLSEAKKLNESQAPK

SEQ ID NO: 1084 - protein, 29 aa, Artificial Sequence
  Engineered Polypeptide
  MISC_FEATURE (7)..(8): FcRn binding motif.
ADNKFNKDPSQSANLLAEAKKLNDAQAPK

SEQ ID NO: 1085 - protein, 29 aa, Artificial Sequence
  Engineered Polypeptide
  MISC_FEATURE (7)..(8): FcRn binding motif.
ADNKFNKDPSVSKEILAEAKKLNDAQAPK

SEQ ID NO: 1086 - protein, 32 aa, Artificial Sequence
  Engineered Polypeptide
  MISC_FEATURE (10)..(11): FcRn binding motif.
ADAQQNNFNKDPSQSTNVLGEAKKLNESQAPK

SEQ ID NO: 1087 - protein, 27 aa, Artificial Sequence
  Engineered Polypeptide
  MISC_FEATURE (5)..(6): FcRn binding motif.
AQHDEDPSQSANVLGEAQKLNDSQAPK

SEQ ID NO: 1088 - protein, 29 aa, Artificial Sequence
  Engineered Polypeptide
  MISC_FEATURE (7)..(8): FcRn binding motif.
VDNKFNKDPSQSANLLAEAKKLNDAQAPK

SEQ ID NO: 1089 - protein, 29 aa, Artificial Sequence
  Engineered Polypeptide
  MISC_FEATURE (7)..(8): FcRn binding motif.
AEAKYAKDPSESSELLSEAKKLNKSQAPK

SEQ ID NO: 1090 - protein, 29 aa, Artificial Sequence
  Engineered Polypeptide
  MISC_FEATURE (7)..(8): FcRn binding Motif
VDAKYAKDPSQSSELLAEAKKLNDAQAPK

SEQ ID NO: 1091 - protein, 29 aa, Artificial Sequence
  Engineered Polypeptide
  MISC_FEATURE (7)..(8): FcRn binding motif.
VDAKYAKDPSQSSELLAEAKKLNDSQAPK

SEQ ID NO: 1092 - protein, 29 aa, Artificial Sequence
  Engineered Polypeptide
  MISC_FEATURE (7)..(8): FcRn binding motif.
AEAKYAKDPSQSSELLSEAKKLNDSQAPK

SEQ ID NO: 1093 - protein, 29 aa, Artificial Sequence
  Engineered Polypeptide
  MISC_FEATURE (7)..(8): FcRn binding motif.
AEAKYAKDPSQSSELLSEAKKLSESQAPK

SEQ ID NO: 1094 - protein, 29 aa, Artificial Sequence
  Engineered Polypeptide
  MISC_FEATURE (7)..(8): FcRn binding motif
AEAKYAKDPSQSSELLSEAKKLESSQAPK

SEQ ID NO: 1095 - protein, 29 aa, Artificial Sequence
  Engineered Polypeptide
  MISC_FEATURE (7)..(8): FcRn binding motif.
VDAKYAKDPSQSSELLSEAKKLNDSQAPK

SEQ ID NO: 1096 - protein, 29 aa, Artificial Sequence
  Engineered Polypeptide
  MISC_FEATURE (7)..(8): FcRn binding motif.
VDAKYAKDPSQSSELLSEAKKLSESQAPK

SEQ ID NO: 1097 - protein, 29 aa, Artificial Sequence
  Engineered Polypeptide.
  MISC_FEATURE (7)..(8): FcRn binding motif.
VDAKYAKDPSQSSELLSEAKKLESSQAPK

SEQ ID NO: 1098 - protein, 29 aa, Artificial Sequence
  Engineered Polypeptide
  MISC_FEATURE (7)..(8): FcRn binding motif.
VDAKYAKDPSQSSELLAEAKKLNKAQAPK

SEQ ID NO: 1099 - protein, 29 aa, Artificial Sequence
  Engineered Polypeptide
  MISC_FEATURE (7)..(8): FcRn binding motif.
AEAKYAKDPSQSSELLAEAKKLNKAQAPK

SEQ ID NO: 1100 - protein, 16 aa, Artificial Sequence
  Engineered Polypeptide
  MISC_FEATURE (8)..(9): Individual Z variant.
  MISC_FEATURE (12)..(13): Albumin Binding Domain.
AQHDEALEVDYVYVPG

SEQ ID NO: 1101 - protein, 14 aa, Artificial Sequence
  Engineered Polypeptide
  MISC_FEATURE (12)..(13): Individual Z variant.
MGSSHHHHHHLQVD

SEQ ID NO: 1102 - protein, 17 aa, Artificial Sequence
  Engineered Polypeptide
  MISC_FEATURE (1)..(1): Individual Z variant.
  MISC_FEATURE (9)..(10): Individual Z variant.
GTGGGGSPRLEHHHHHH

SEQ ID NO: 1103 - protein, 25 aa, Artificial Sequence
  Engineered Polypeptide
  MISC_FEATURE (1)..(1): Individual Z variant.
  MISC_FEATURE (17)..(18): Individual Z variant.
GTGGGGSGGGGSGGGGSLEHHHHHH

SEQ ID NO: 1104 - protein, 49 aa, Artificial Sequence
  Engineered Polypeptide
  MISC_FEATURE (1)..(1): Individual Z variant.
  MISC_FEATURE (21)..(22): Albumin binding variant PP013.
  MISC_FEATURE (40)..(40): Z variant Z03638.
GAPGGGGSGGGGSGGGGSGGGGSTSGTGGGGSGGGGSGGGGSGGGGSPR

SEQ ID NO: 1105 - protein, 25 aa, Artificial Sequence
  Engineered Polypeptide
  MISC_FEATURE (1)..(1): Z variant Z03638
  MISC_FEATURE (20)..(20): Albumin binding variant PP013.
GAPGGGGSGGGGSGGGGSGGGGSTS

SEQ ID NO: 1106 - protein, 14 aa, Artificial Sequence
  Engineered Polypeptide
  MISC_FEATURE (12)..(13): Individual Z variant.
MGSSHHHHHHLQVD

The invention claimed is:

1. An FcRn binding polypeptide, comprising an FcRn binding motif BM, which motif consists of the amino acid sequence $$\text{EX}_2 \text{ X}_3 \text{ X}_4 \text{ AX}_6 \text{ X}_7 \text{ EIR WLPNLX}_{16}\text{X}_{17} \text{ X}_{18} \text{ QR X}_{21} \text{ AFIX}_{25} \text{ X}_{26}\text{LX}_{28} \text{ X}_{29}$$
(SEQ ID NO: 1075)

wherein, independently from each other,
- $X_2$ is selected from A, D, E, F, H, I, K, L, N, Q, R, S, T, V, W and Y;
- $X_3$ is selected from A, D, E, F, G, H, I, K, L, M, N, Q, R, S, T, V, W and Y;
- $X_4$ is selected from A, D, E, F, G, H, I, K, L, N, Q, R, S, T, V, W and Y;
- $X_6$ is selected from A, E, F, G, H, I, K, Q, R, S and V;
- $X_7$ is selected from A, F, H, K, N, Q, R, S and V;
- $X_{16}$ is selected from N and T;
- $X_{17}$ is selected from F, W and Y;
- $X_{18}$ is selected from A, D, E and N;
- $X_{21}$ is selected from A, S, V and W;
- $X_{25}$ is selected from D, E, G, H, I, K, L, N, Q, R, S, T, V, W and Y;
- $X_{26}$ is selected from K and S;
- $X_{28}$ is selected from A, D, E, F, H, I, K, L, N, Q, R, S, T, V, W and Y; and
- $X_{29}$ is selected from D and R.

2. The FcRn binding polypeptide according to claim 1, wherein the BM consists of the amino acid sequence $$\text{EX}_2 \text{ X}_3 \text{ X}_4 \text{ AX}_6 \text{ HEIR WLPNLTX}_{17} \text{ X}_{18} \text{ QR X}_{21} \text{ AFIX}_{25} \text{ KLX}_{28} \text{ D}$$
(SEQ ID NO: 1076)

wherein, independently from each other,
- $X_2$ is selected from A, D, E, F, H, I, K, L, N, Q, R, S, T, V, W and Y;
- $X_3$ is selected from A, D, E, G, H, K, L, M, N, Q, R, S, T, V and Y;
- $X_4$ is selected from A, D, E, F, G, I, K, L, N, Q, R, S, T, V and Y;
- $X_5$ is selected from A, G, K, R, S and V;
- $X_{17}$ is selected from F, W and Y; $X_{18}$ is selected from A, D, E and N;
- $X_{21}$ is selected from A, S, V and W;
- $X_{25}$ is selected from D, G, H, K, L, N, R, V and W;
- $X_{28}$ is selected from A, D, E, H, K, L, N, Q, R, S, T, W and Y.

3. The FcRn binding polypeptide according to claim 1, wherein the sequence fulfills at least three of the six conditions I-VI:
- I. $X_6$ is selected from A, G, K and S;
- II. $X_7$ is H;
- III. $X_{17}$ is selected from F and Y;
- IV. $X_{18}$ is D;
- V. $X_{21}$ is selected from V and W;
- VI. $X_{25}$ is selected from H and R.

4. The FcRn binding polypeptide according to claim 1, wherein the sequence is selected from the group consisting of SEQ ID NO:1-353.

5. The FcRn binding polypeptide according to claim 1, wherein said FcRn binding motif forms part of a three-helix bundle protein domain.

6. The FcRn binding polypeptide according to 1, which comprises the amino acid $$\text{K-[BM]-DPSQS X}_a\text{X}_b\text{LLX}_c \text{ EAKKL X}_d\text{X}_e\text{X}_f\text{Q;}$$
(SEQ ID NO: 1077)

wherein [BM] is an FcRn binding motif according to claim 1, provided that $X_{29}$ is D;
- $X_a$ is selected from A and S;
- $X_b$ is selected from N and E;
- $X_c$ is selected from A, S and C;
- $X_d$ is selected from E, N and S;
- $X_e$ is selected from D, E and S; and
- $X_f$ is selected from A and S.

7. The FcRn binding polypeptide according to claim 6, wherein the sequence is selected from the group consisting of SEQ ID NO:354-706.

8. The FcRn binding polypeptide according to claim 1, which comprises the amino acid sequence

```
                                                    (SEQ ID NO: 1078)
AEAKYAK-[BM]-DPSQSSELLSEAKKLNDSQAPK;
``` wherein [BM] is an FcRn binding motif as defined in claim 1.

9. The FcRn binding polypeptide according to claim 8, in which the sequence is selected from the group consisting of SEQ ID NO:1060-1062.

10. The FcRn binding polypeptide according to claim 1, which comprises the amino acid sequence

```
                                                    (SEQ ID NO: 1079)
VDAKYAK-[BM]-DPSQSSELLSEAKKLNDSQAPK;
``` wherein [BM] is an FcRn binding motif as defined in claim 1.

11. The FcRn binding polypeptide according to claim 10, in which the sequence is selected from the group consisting of SEQ ID NO:707-1059.

12. The FcRn binding polypeptide according to claim 1, which is capable of binding to FcRn at pH 6.0 such that the $K_D$ value of the interaction is at most $1\times10^{-6}$ M.

13. The FcRn binding polypeptide according to claim 1, wherein the $K_D$ value of the interaction between FcRn binding polypeptide and FcRn at pH 7.4 is higher than the $K_D$ value of said interaction at pH 6.0.

14. The FcRn binding polypeptide according to claim 1, wherein the $K_D$ value of the interaction between FcRn binding polypeptide and FcRn at pH 7.4 is at least $1\times10^{-8}$ M.

15. The FcRn binding polypeptide according to claim 1, wherein the $K_D$ value of the interaction between FcRn binding polypeptide and FcRn at pH 7.4 is at most $1\times10^{-6}$ M.

16. The FcRn binding polypeptide according to claim 1, which inhibits binding of IgG to FcRn.

17. A composition comprising an FcRn binding polypeptide according to claim 1 and at least one pharmaceutically acceptable excipient or carrier.

18. The FcRn binding polypeptide according to claim 3, wherein the sequence fulfills at least three of the six conditions I-VI:
I. $X_6$ is A;
II. $X_7$ is H;
III. $X_{17}$ is F;
IV. $X_{18}$ is D;
V. $X_{21}$ is V;
VI. $X_{25}$ is H.

19. The FcRn binding polypeptide according to claim 4, wherein the sequence is selected from the group consisting of SEQ ID NO:1-15, SEQ ID NO:17-140 and SEQ ID NO:353.

20. The FcRn binding polypeptide of claim 19, wherein the sequence is selected from the group consisting of SEQ ID NO:1-2 and SEQ ID NO:17-140.

21. The FcRn binding polypeptide of claim 4, wherein the sequence is selected from the group consisting of SEQ ID NO:17-92, SEQ ID NO:94-103, SEQ ID NO:105-125 and SEQ ID NO:127-140.

22. The FcRn binding polypeptide according to claim 7, wherein the sequence is selected from the group consisting of SEQ ID NO:354-368, SEQ ID NO:370-493 and SEQ ID NO:706.

23. The FcRn binding polypeptide according to claim 22, wherein the sequence is selected from the group consisting of SEQ ID NO:354-355 and SEQ ID NO:370-493.

24. The FcRn binding polypeptide of claim 22, wherein the sequence is selected from the group consisting of SEQ ID NO:354-361, SEQ ID NO:370-445, SEQ ID NO:447-456, SEQ ID NO:458-478 and SEQ ID NO:480-493.

25. The FcRn binding polypeptide according to claim 11, in which the sequence is selected from the group consisting of SEQ ID NO:707-721, SEQ ID NO:723-846 and SEQ ID NO:1059.

26. The FcRn binding polypeptide according to claim 25, in which the sequence is selected from the group consisting of SEQ ID NO:707-708 and SEQ ID NO:723-846.

27. The FcRn binding polypeptide according to claim 26, in which the sequence is selected from the group consisting of SEQ ID NO:707-708, SEQ ID NO:723-798, SEQ ID NO:800-809, SEQ ID NO:811-831 and SEQ ID NO:833-846.

28. The FcRn binding polypeptide according to claim 12, which is capable of binding to FcRn at pH 6.0 such that the $K_D$ value of the interaction is at most $1\times10^{-7}$ M.

29. The FcRn binding polypeptide according to claim 28, which is capable of binding to FcRn at pH 6.0 such that the $K_D$ value of the interaction is at most $1\times10^{-8}$ M.

30. The FcRn binding polypeptide according to claim 29, which is capable of binding to FcRn at pH 6.0 such that the $K_D$ value of the interaction is at most $1\times10^{-9}$ M.

31. The FcRn binding polypeptide according to claim 30, which is capable of binding to FcRn at pH 6.0 such that the $K_D$ value of the interaction is at most $1\times10^{-10}$ M.

32. The FcRn binding polypeptide according to claim 13, wherein the $K_D$ value of the interaction between FcRn binding polypeptide and FcRn at pH 7.4 is two times higher than the $K_D$ value of said interaction at pH 6.0.

33. The FcRn binding polypeptide according to claim 32, wherein the $K_D$ value of the interaction between FcRn binding polypeptide and FcRn at pH 7.4 is five times higher than the $K_D$ value of said interaction at pH 6.0.

34. The FcRn binding polypeptide according to claim 33, wherein the $K_D$ value of the interaction between FcRn binding polypeptide and FcRn at pH 7.4 is at least 50 times higher than the $K_D$ value of said interaction at pH 6.0.

35. The FcRn binding polypeptide according to claim 34, wherein the $K_D$ value of the interaction between FcRn binding polypeptide and FcRn at pH 7.4 is at least 100 times higher than the $K_D$ value of said interaction at pH 6.0.

36. The FcRn binding polypeptide according to claim 14, wherein the $K_D$ value of the interaction between FcRn binding polypeptide and FcRn at pH 7.4 is at least $1\times10^{-7}$ M.

37. The FcRn binding polypeptide according to claim 36, wherein the $K_D$ value of the interaction between FcRn binding polypeptide and FcRn at pH 7.4 is at least $1\times10^{-6}$ M.

38. The FcRn binding polypeptide according to claim 37, wherein the $K_D$ value of the interaction between FcRn binding polypeptide and FcRn at pH 7.4 is at least $1\times10^{-5}$ M.

39. The FcRn binding polypeptide according to claim 15, wherein the $K_D$ value of the interaction between FcRn binding polypeptide and FcRn at pH 7.4 is at most $1\times10^{-7}$ M.

40. The FcRn binding polypeptide according to claim 39, wherein the $K_D$ value of the interaction between FcRn binding polypeptide and FcRn at pH 7.4 is at most $1\times10^{-8}$ M.

41. The FcRn binding polypeptide according to claim 40, wherein the $K_D$ value of the interaction between FcRn binding polypeptide and FcRn at pH 7.4 is at most $1\times10^{-9}$ M.

42. The FcRn binding polypeptide according to claim 41, wherein the $K_D$ value of the interaction between FcRn binding polypeptide and FcRn at pH 7.4 is at most $1 \times 10^{-10}$ M.

43. A fusion protein or conjugate comprising
the FcRn binding polypeptide according to claim 1; and
a polypeptide having a desired biological activity.

44. The fusion protein or conjugate according to claim 43, which inhibits binding of IgG to FcRn.

45. A composition comprising a fusion protein or conjugate according to claim 43 and at least one pharmaceutically acceptable excipient or carrier.

46. A polynucleotide encoding a polypeptide according to claim 1.

* * * * *